United States Patent 7,745,391 (HUMAN THROMBOSPONDIN POLYPEPTIDE) - sequence listing, part 176

SEQ ID NO: 437634 - DNA, 7943 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437635 - DNA, 7887 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggacacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437636 - DNA, 6392 bp, Homo sapiens
acactaccagcctaggtaaaaaatacaaaaagtaactgggcatggcggcgcccatctatagtcccacctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437637 - DNA, 7209 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437638 - DNA, 6029 bp, Homo sapiens
  misc_feature (56)..(57): n is a, c, g, or t
ggctgacaatacagtgtaacactcagcatcggtatctttttgagacagtctactcnncgttgcccaggtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437639 - DNA, 5994 bp, Homo sapiens
aatttttttttttttttttttttttgagacggagtctcactctgccgcccaggctggagtgcagtggcgtgatctcggctcactacaacctccgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437640 - DNA, 5229 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctgcaccgttgacctgtgcatcatggactttctaaatataactcccaggggcggttggttcacaaatctcccttgctttaggacgattccaaatctctgg

SEQ ID NO: 437641 - DNA, 5146 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacttgaaagccccaagcggcaactcaaagcctcagc

SEQ ID NO: 437642 - DNA, 4498 bp, Homo sapiens
ggtgagggcttaccgggaagaactatggtcagggagtggcttcccagggctggggttaacgcattggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437643 - DNA, 5150 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437644 - DNA, 4257 bp, Homo sapiens
atcgagccgtgaccccccgactagcccgacaggctcacaacctcagaaacctaaactatatagcagcggggtggtggcagcagccacccacaaaaagcaagaggcaggtgaattcccagcatccccctccacccacctgcctcctctgcttctgagagttaaggtcacgccaccaccttggtccctattctcacacactagaagacgggttagcagtttggcactccatgtggaaaagtggccaacccctgtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437645 - DNA, 2668 bp, Homo sapiens
acactaccagcctaggtaaaaaatacaaaaagtaactgggcatggcggcgcccatctatagtcccacctccagagtagctgggactacaggcgcctgccaccacgcctggctaatttttttgcacttttagtagagacggggtttcactgtgttagccaggatggtctcgatctcctgaccttgtgatccgcccgcctcggcctcccaaagtgctgggattacaggcgtgagccaccgcgcccagccaaattaaattttttatagagatgaggtcatgctgttatgttgcccaggttggcctcatgagatccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437646 - DNA, 2141 bp, Homo sapiens
tattcgtagctgtgcagtagaattcgaccctgtgacttgactgtagcttaaatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437647 - DNA, 1444 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgacgtaagctgtcttgaccgctaccatttctctagtagaggcgggacgcggcggcgcggagtgatgacgcgctctgctggcggctggagggttgcggagcacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccagcggcaggtgacgagccacacagtgtcctgaggcctgatgaaagggctatgccaaccacagtcccagaggaggagctggctgtagcagcgactgacccaggagctgaagtgagccaagccccctcctcctgagacccctgagagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcgtgagcgtcctgcccttgccctcctggacccccagcctgctccctggcctccgctctccttttctctctccctgtacttcctgcctttctctgtcatcctctttcttgtcactgtgaagcgatgaataaacctgggtgtagatccaggctgagccactta

SEQ ID NO: 437648 - DNA, 209 bp, Homo sapiens
tccagcctgggcgacagagtggtattctgtttcaaaaaaaaaaaaaaaggcagtatgtagccccgaagactgttgcccaagtggtagaatgttagcacactaccagcctaggtaaaaaatacaaaaagtaactgggcatggcggcgcccatctatagtcccagctacatgggaggctgaggtgggaagataagtcacttgagcccgcca

SEQ ID NO: 437649 - DNA, 4237 bp, Homo sapiens
  misc_feature (4052)..(4052): n is a, c, g, or t
  misc_feature (4117)..(4118): n is a, c, g, or t
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcgcgcctgtggtcccagcactttgggaggccaaggtgggcagatcgcctgaggtctggagttcaagaccagcctggccnacggggtgaaaccccgtctctacaaaaataagaaaattggccaggtgtggtggcagacgtctgtnntcccagctattcaggaggctgaggcacgagaattccatgaacccaggatgcggaggttgcagtgagccgagattgtgccactgcgctccagcctgggcgacagagtggtattctgtttc

SEQ ID NO: 437650 - DNA, 7837 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagccgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggtgaccgagtgatactctgtctcaaagaaaaaaaattataattttagcacagtaaccagccatgatgggagataccctgggtaaggcatgtagaaagggttgagggaccttcccagtcccctagccccgcctcccatcctcccatctttttcttttttcttttttttagagaatcacccagcctggagcgaagtggtgcaatcataactcactgtatccttaaactcccgggcttaagcgatcctcctgcctcagccttctgagtaactaggacttcaggtacctaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgatgatgaatgatgggtgtgtccagtggcagtttgccccactgaggcaggggcttccactaggccctgacagagcccttccagcaggcagaaatccctgtgctaggcaagattcaaactccgtagcatgtctcctgctcccatctcttaggaatggagtccttcaggccttgagtcccacattttccatgatgctccattaagcagctgatagcacccccacctccagggaaagtgagttcagagtccttggtctaatgcatctgtgttgaaattgaggccttcccctgtgttcacctttctgctctttttcttttagcccaaggctatgaaggcctcattcggtgctgggcatggtcactcctagcattcctcactctgttgctaacagcaacagcaataataataagggttacaacttactccataccttactgtctgccaggcattaagctaagtgctttacatatattaagtcatttaatcctcataatgaccctatgaaagagataccatctcaacccaattgacagctggtttgcaagattaggagggatgaaggacccaggggacaatgcgagggaaaactctgaccccggggccccaggctggatgttctttatgcctgtgaaccacagcttatcacatgtctggagttagggaccccacttaaagtgagattttggctggaggtggtggatcatacctataatcccagcactttgggagaccaaggcagaaggactgcttgaggccaggagttcaaaaccagtgtaggtaacagctagaccctatctctacaaaaaatttaaaaattagctgggtgtggtggtatgtgcctcaagttccagctactcaggaggctgaggtgggaggatcacttgagcacaggagtttgaagttacagtgagctatgatggcaccactgcacttcagcctaggcaacagagggagaccctgtctttaaagtacatagaggtttttcacaccaacacatctctgcccagtgtgccaacatctgccacctgctataatagtactataacactcaatatgtaattaatgtagtctcagggatgttatgacaatatgattacaactatcacgtgtgtgcccagccaggctcaatgccccaggctgggcgaggtggggcaggggacacagcctaaaatgccaggcctcaggaagccatttggtttagcagacattgtttattaaaggagttacctatgccagatcgaaggcctaagatgattaagacactatgagtgccttcaagtggttggggacgttcatgattgtggtacagacaaataggctttcacatcattcttttatgtaatcatacaacagatatttgcacctacatgtgcagagcactgtgataggcctcagtgacacagaataatacggcaaagaccccacccgatgagccccctcccaccacccaccagtacagtagggggtggtttaatggagtgttcctggaatatgaagtgggggcaggcattaggggtggcaaagggacaagtgtttatctgatcagttatgtactgtttataataagtaaatcagcagagggggaataatacttagaacctatagagagtaaatctgacaagatgaaatgctgatgaaaatatggaggaaatgaaactctcatgggttttgcagggaatctaagtcagtgctgtgttgtgaatgtaggtgtaccctttgaattcatatgttgaatcctaacccccaaagcaatggcattaagaggtggggcctttggggctgggtatggtggctcatgactgtaatcccagcactttgggatgctggcagggggcagatcacttgaagccaggagtctgagatcagcctggccaacatggtgaaaccccatctgtactaaaaatacaaaaattagccaggtgtgatggcgtacatctgtaatttcagccactcgggaggctgagacaggagaatagcttgaacccagtaggtggagatttcagtgagccgagatcgtgccactgcactccagcctgggtgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437651 - DNA, 6337 bp, Homo sapiens
  misc_feature (4052)..(4052): n is a, c, g, or t
  misc_feature (4117)..(4118): n is a, c, g, or t
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacatgggccgagcgcagtggctcgcgcctgtggtcccagcactttgggaggccaaggtgggcagatcgcctgaggtctggagttcaagaccagcctggccnacggggtgaaaccccgtctctacaaaaataagaaaattggccaggtgtggtggcagacgtctgtnntcccagctattcaggaggctgaggcacgagaattccatgaacccaggatgcggaggttgcagtgagccgagattgtgccactgcgctccagctgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437652 - DNA, 5987 bp, Homo sapiens
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatctacaccctgccttggctgctacagctttttcactccactgccctaggggagttcagcaacctaatgatctctatctctgaacatctcttcatcccatgctccaagtccagcaacctgcaccctggaaccaggagtggaccctacccgagctgtctgtattaatccccatcccccaccaccaatcttaaaaagccctctgtccccctaccctaaaccccagttaggtacccatgctgggcaggtcagttaacaatttatgcacaggtactagttttattgtattaccgttccagggtagctttgaaaaaagtatctcaaaaaggcaacaccaccgcgcccagccaaattaaattttttatagagatgaggtcatgctgttatgttgcccaggttggcctcatgagatcttgccttagcctcccaaagtgctgggattacagatgtgagacactgcacccaaaccccaccacttttttttttcctttttctttttttgagacagtcttactccgttgcccaggctggagtgtagtggcatgatctcagctcactgcaacctccgcctcccgggttcaagcaattctcctgcctcagcctcccgagtagctgggattacagaggcctgccaccacacccgactaattttcgtatttttagtagagacggggtttctccatgttggccaggctgttcttgaactcctgacctcaagtgctccacctgcgttggcttcccaaagtgctgggatacaggagtgagccactgcgcctggctgatcccagcacttttcaaatgatgccgctcaaagccgtgacttggcctactttgaacagcaaacttgttgctgctgttgtcaacctgaaggcctctcaaatgccagcttcaagcagggtgtgaattggccagtgtcagatctcaggagtcctgtgttgagagtgtggctttcagctgcggggagctgcacttggtggggaaagccaggcaggtcaccctcacagccagataatgtggaggtcagaacccaaggaagggagtgagacctccactcccagtgggggacctggccacccatccttggggacctgagaaagcgtacttcaccttggggtgaaggctgggtggggccagagggaccagtgccctcctcagtgcttaggggcagagccacctgcagcaatggtatctgcatattagcccctctccaccttctttctcccgctgaatcatttccctcaaagcccaagagctgtcactgcttctttctccctgggaagaatgcgtggactctgcctggtgatagactgaagccagaacagtgccacaccctcgccttaattccttgctaggtgttctcagatttatgagacttcttagtcaaatatgagggaggttggatgtggtggcttgtgcctgtaatcccagcattttgggaggccgaggtgggaggatcccttgaagccaggagtttgagacaagcctgggcaacaaagcaagaccctatctctaaaaaaaaaaaaaaaaaaaaatctaggagatgctctttaccctgcctggcctcaaactattaatagcttcctttgagcaacattatttattatgaactttcaaacacaaaaaagtagagagagtagaataacaaatccccatgagcccatcacccaacttcagtaattatcaattcatggccatcttgttcacccctgcctgcttccctgcttcccctcattctgcagaggttcttttcttttgagacagagtgttgctctgttgcccaggctggagtgcagtggtgcaacttcggctcactgcaacctccgcctcccaggttcaagtgattctcctgcttcagcctctcaagtagctgggattacagatgcccgccaccacacctggctaattttcgtatttttgttagagatggggtttcaccatgttggccaggctggtctcgaactcctgacctcaagtgatccgcccgccttggcctcccaaaatgctgggattacaggtgtgaaccacggtgcctggccactgtacaggttatttatagaagttggagagtgaagggttgagaaagccaaggggcagatgcgggtctggaggattttgtgcctaaggccctctctttgctcccagacagcatgaagtaacaatgaggcatccacctcttggttttgtggcctctgtggatgacgtctctcaccttgaaccagttcagagttggagtagcgcaggatcctgtcttcagaggaggggccgaagcgggttcctctgttgtcaagctctttggaggtgcctggctgctactactgtcccagagaggtgagagacgtcatccgaagcagtcgacaaagatcctct

SEQ ID NO: 437653 - DNA, 5917 bp, Homo sapiens
  misc_feature (3632)..(3632): n is a, c, g, or t
  misc_feature (3697)..(3698): n is a, c, g, or t
gcgggaagggtcctgggccccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacccttcagcggcggcccggctgggtggagtacttcattgcggcactgaggggctgtgagctagttgatctcgcggacgaagtggcctctgtctaccagagctaccagcctcggacctcggaccgtcccccagacccactggagccaccgtcacttcctgctgagaggccagggccccccacacctgctgcggcccacagcatcccctacaacagctgcagagagaaggagccaagttaccccatgcctgtccaggagacccaggcgccagagtccccaggagagaattcagagcaagccctgcagacgctcagccccagagccatcccaaggaatccagatggtggccccctggagtcctcctctgacctggcagccctcagccctctgacctccagcgggcatcaggagcaggacacagaactgggcagtacccacacagcaggtgcgacctccagcctcacaccatcccgtgggcctgtgtctccatctgtctccttccagcccctggcccgttccacccccagggcaagccgcttgcctggacccacagggtcagttgtatctactggcacctccttctcctcctcatcccctggcttggcctctgcaggggctgcagagggtaaacagggtgcagagagtgaccaggccgagcctatcatctgctccagtggggcagaggcacctgccaactctctgccctccaaagtgcctaccaccttgatgcctgtgaacacagtggccctgaaagtgcctgccaacccagcatctgtcagcacagtgccctccaagttgccaactagctcaaagccccctggtgcagtgccttctaatgcgctcaccaatccagcaccatccaaattgcccatcaactcaacccgtgctggcatggtgccatccaaagtgcctactagcatggtgctcaccaaggtgtctgccagcacagtccccactgacgggagcagcagaaatgaggagaccccagcagctccaacacccgccggcgccactggaggcagctcagcctggctagacagcagctctgagaataggggccttgggtcggagctgagtaagcctggcgtgctggcatcccaggtagacagcccgttctcgggctgcttcgaggatcttgccatcagtgccagcacctccttgggcatggggccctgccatggcccagaggagaatgagtataagtccgagggcacctttgggatccacgtggctgagaaccccagcatccagctcctggagggcaaccctgggccacctgcggacccggatggcggccccaggccacaagccgaccggaagttccaggagagggaggtgccatgccacaggccctcacctggggctctgtggctccaggtggctgtgacaggggtgctggtagtcacactcctggtggtgctgtaccggcggcgtctgcactagtgaagccctgggctcttcccaccacccatctgttccgttcctgcagtatacctggcccctctccgaagccccttgtccctttcttggggattgtggaggctgggtcagaggggagttaagggactgcaggcctggcagcaggacatgccttggctgaaccaagtcctgagagcagcatctctgtccccacggtgccttgtgtgggtccccgtccttggctttctgggtcctgggctgcccccagtgctccagaccttccccactggcaatccaggttatcatccatgtcctccagaggagcttcctcctccaggcctcagccctgttggcccaggtggagcaggagggaccactggaacatgtggtgcttgggaatgcctctcctgttgcattggtccctgaaggcctcagggcaggtatgtggtgtgtgggcgactccacaagacctgcctcccatcctggcagcccagcctgagaccgttgcattgaggcaggcaggagcggcagggtggctgctctccaggagcccaactgccttgagttcctgccccactgggccccctcccctgctgggcaatcctgggaaggtctggaggttcctgtggacctcagggaagccaggggcagctgtcaggcctgaggaagacctgtggagctcctctccagcctcctctttccctcccctctggtctccattctcttcagctccctacatgggctggggaggagacacctggtgggcagagctcaggcagaggtttggatttcagctccctcacttccggggctgtgtggctttggcagatgtcagacttctggtcttgcttctccacgtggacagtgagtatctggctcattcttcactgggttcttctgagattgaacctacaggtgtttgccaagtgcctggcccagagcaagtggccactgcttctcccatctctctcctgcccaacctggtagagctgagggcatgagaggcagagtgcacagtggtcaagggtgcagctctgcagcacaggcagcctaggcctgcgtcccaacctgcctctcaccagctctgtgaccttgggcaagggatttatctgtctgtcccttagttttctcacctgtaaaaggaggataagtatatatatatatttcccagtgttgtgaagattaaaggagtttatcgatgtaggtcttaggatgagtcctggcatttaccaagggttggatatatgttattatcactattaagtgttgagggtccaggcatgctgggcaacagggaccccatctctacaaaaaagtttaaaaaattagccaggcgtggtggtgcacctgtcgtcttagctacttgggaggctgaggtgggaggatcacttgagcccagaagcttgaagctgcagtgagctaggatcgtgccactgcactccaacctgggtgagagagcgagaccctgtctcaagaaaaagaaaaatgcagagaaacaggagtcttggctactcctttagaggcagactcagaccctcctgcctcacagctttatctttgtatttgccccttactttatcttgtgccttgagaaattgctggggagagaggtatgtccactgggcagctgtacaggatggaggatatagggcgtttccactcccagcagccaggttccctcaccccaagctcaccccagttaggtacccatgctgggcaggtcagttaacaatttatgcacaggtactagttttattgtattaccgttccagggtagctttgaaaaaagtatctcaaaaaggcaacatgggccgagcgcagtggctcgcgcctgtggtcccagcactttgggaggccaaggtgggcagatcgcctgaggtctggagttcaagaccagcctggccnacggggtgaaaccccgtctctacaaaaataagaaaattggccaggtgtggtggcagacgtctgtnntcccagctattcaggaggctgaggcacgagaattccatgaacccaggatgcggaggttgcagtgagccgagattgtgccactgcgctccagctgacagagcgagactccatctcaaaaaaataataaagatgtggggcctgtgggaggtggttaggtcatgagggtggagatcatgaatggggttagcaccttataaaacaggcttgagggagcccttctgtcccttctaccatgtgtggatgcagtgagaaggcaccgtatctctgaagcagagagcccgccctggacactggatctgctggcaccttgatcttggacttcccagcctctagaactgtgagaaataattttttgttgtttacaaattacccaggctaaggtgtttcattgtaacctgaatggaccaagctggtgtgaccctgttggaaaactggcagtatctaccaaaagccgaacatacgtataaactgatccagcagttccactcctgggtatgtacaccacagaaagctatgtccaccgagacattggcaagaatgtttctaaccacacgctgactgtagccccaaacctgaaacaacccaaatgtccatccaccaacccaaatgtccatccacagttgaagctacagtgaagtcacagggtcgaatactactgcacagcaacgaatatgaatgaaaatatcgctatgcacagcaacatggataaatttcacagacatgaggtcaagcaaaagaggtcagagtcctcatcatcaagagagaattcattgtatgattctcttcctacaaaaagtacagaaataagcaaaactgatccatggtgttagaagccaggggaacagttaacaggggagggatactggggaggggcatcctggagtgctggtctacctcatctgggtgttgatttcacgagtattgtcagtttgtttccagactccctgttggagatgtggaaataaaaaccacctaaacaagagcagagaggccatttggtcaaagtttgcaaaggagtcagccatgattgcttgtatttggcaggggtcaaaggcaggcagggactgtgaaatgttatagtggaaaaaaagggaaggctctgggtgtgctgtgattggagattgttggcatggggacagagcggactaactggaggggcatctttggttggttgggggggtatatttggctttctctggttggtctggagttggaagagggggtgtggtggctggggattgggaagaagctggcagccactaagttcagactgttctgggtccgattgctgctgaggctgtggtttggcttccttggcttcccaggctggttatgggtttctggccagagtctattgtcatatgtggcctggccattgtccagttgtatgttcagtctcttggaaggaagggtattgactctgagaggggccaccatcgctggaatgggggacacacagtacttcctccagctgcctacacccccctagggtcagtggcgcctgcctgtgagggtgagcccaatggctagagggctctgctccaagtcattgcttactacacccacaaacattcttcgttctttaaggcctaacttaaagcccagatcctacaggaaaccttgattagacccctctctttattaagcttcctaagatcaaaccctgcttttgtgtaaatgctgacctccttgcctacattttaaaaacctagagctgggcatgatggccccagcctgtaatcccagtgattcaggagactgaggtgggaggattgctagaagccaggagttcgagaccagcctgggtaacatagctagaccacatctcttaaaataaaatagttaatttagccaggcatgatgatatatgcctgtagtcccaactacttggaaggctgaggtgtgaggatctttgagcccgggaggtcgaggctacagtaagctatgatctcaccactgtactccagcctgggtgacagagcgagacccagactcaaaaaataaaaataaaaaccctgaatatcttccttctgcaaaaaaaaaaaaaaaaaaaaaaaaaaaaaaaaaaaaaaatctaggagatgctctttaccctgcctggcctcaaactattaatagcttcctttgagcaacattatttattatgaactttcaaacacaaaaaagtagagatagaataacaaatccccatgactccatctacccatctggaccactat

SEQ ID NO: 437654 - DNA, 2124 bp, Homo sapiens
gcggccgccggggtcggcagcctggggctccgctgatctagggcaacgagcgggggacgcttcgagcccgcagcgagagtgaccagcatggtccctgccggcagctcggggccggagggttttgactgcaaggccagcccacgccgagggtccaagcatcgggatatgccgccagcacctggctgctgcagcaccgcgctggacatgagcgctccgcccaacccgacggcgtcagctggcgcgcgcgcccgcgaccgacgtgcgcaggcgcccacgggccgcgcagccgccattgctctcctgccacggaggggagcgcttggtggcagtccgcgggcccggacggaaggctgaggcgacgcctcgacgacagcggaccggagctgcaggggcaacacattcagggcggggtgccccatttaggcctggctgaccggagtaagaaactacaacccccgaagtgccttgcgcctcaaggttacggaggcagtgaccacccaccctggagccatggtccacgccttcctcattcacaccttgagggccccgaatactgaggacacgggcctttgccgagtgctgtactcctgcgtcttcggtgctgagaagtcacctgatgacccacggccgcatggtgccgagagggacaggcttctccggaaggaacagattttagctgtggccaggcaggtagagtcaatgtgtcggctgcagcagcaggcatctggccggccccccatggacctgcagccgcaatcctcagatgagcaagtgccgctgcacgaggccccacgtggggctttccgcctggcagcagagaaccctttccaggagccacggacggtggtgtggctgggcgtgctctcgttaggctttgccctggtgctggatgcccatgagaacctgctactggctgagggcacgctccggctgctgacacgcctcctccttgaccacctccggctgctggcgcccagcaccagccttctgctgcgggctgaccgcattgagggcatcctcacccgcttcctgccacatggtcagctgcttttcctcaacgaccagtttgtccaaggcctggagaaggaattcagtgccgcttggccccgctgattcctcgttgggatggtgcttctgagggcaggcagagggtagacacacagccagatgaagcttggcatctccctcctacccagcagctctgatgtgctgctataccaggacaagtgggtgacacaagcctgcagaaagggggctgggcagagggtggaggaggtcctgcctgtcctcaggttagtggaaccacagaacttcctgagcctagagctgctgtgttacttagaccgctgccgtgcggcagccacgcttgtccttgaacccaccttcctccatccctgccagccgatagtgctagggtgaggagctgcctggagctcaccccgctcttcttccaaacccacagtcaaggccaggcgcggtggctcacgcctgtaatcccagcactttgcggggctgaggtggttggaccacctcaggtcgggagttcaagaccagcctggccaacatagtgaaaccccatctctactaaaaatacaaaaattagctgggtgtatggcgcccacctgtaatcctagctgctcagggggctgagtcatgggaatcacttgaacctgggaggcagagtttgcagtgagccgagagtgcgccacttcactccagcctgggcaacagagtgagactccatctcaaaaaaaaaaaaaaaatcccacagtcatcgaaacacaaaaggggtctcagactcccctgagggtggaggagctgtgcctgcatgctggcaggccacagcccctggctttgtgcccacttaggcagtattatcaacaaggtcctgctcagtgtccagcccccgctgagttcagaaatgcatctgccaatcagcagcaggattctgcagctccttttgtgccaagcccgttcccaccaggcaggctcgagataaagtcatcacagccttccctcatctgcagggagagaagttgctgtcagatgaatgtgagcagtctagcctggatgacatatttttcgttttgaattaaaagcactggctgtgtgattttaccctct

SEQ ID NO: 437655 - DNA, 152 bp, Homo sapiens
gcggccgcctactactactactgctcgaattcaagcttctaacgatgtacggggacatgccacacaccgtctctcgaggaaacgcggttcagcgattctttgactgcggaccctgtgggaaaccccgtcaataaatgttaaagacacactcc

SEQ ID NO: 437656 - DNA, 1804 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactccacgcacacaaacacacggggggcgcccaaaataccccgggggccagctacgtaccccctctgtcaagg

SEQ ID NO: 437657 - DNA, 1000 bp, Homo sapiens
cattggccttgccccatgcacaggctccaggcggacagagctgctgcaggcatgctgtcagggggacaggctgccccccagctgtgcatggcagtgtgtcggaaagaacaaggcctgtgggtgcccctgagccgggtctggagtcctgtcctgccacttctcagccgtgtgactggagcctctttgctcctctctgaaaatgggtctggtggtttgttcccaggttcttaaccactgtgtggagtcacacctgcagaaggtcagctcataacagatatggcaaccaatgtgacctttgcatccttccttcctggggtcaggagcaggtctaagaggtggtcaggctaaacccctgtagggctgtgggtactgctggtttcctaagccccgggaccttctgggggccgggcggaccttaagttctgtccacctgcctctcctccatcctcactacccaccttgtccttccggctccttccctccctgctccgcctctcatcggccctctgtcctctccgtccggagaggggaacgtgaaggaggtgaggagggagtagtgcaggaggatttgggtctctccttctttcccttttccattctccgagggcttaaccagctggtgaaggttcttaaccagcaaaggaggaagcagccggggccggtgagggtgaggccggcagccaggcaggaaggcagcaggaggaggaggaagcggaggcggcaccttctgagaggcgcatgctcagtgagtcgtgaagatggcagggctggcggagcggccgcatctgatctctcccctttttttaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437658 - DNA, 1068 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggtgaccaccagtgagttaaccaccaagccaagaacttgctcattagcaatagctgacggcacctttttactccctggtccctattcctgcccctacctctacttgaagggaacaactactgaattttctgcagcaccatctaaagacaaaactcaaaggtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttgggcgcctaagtggaactgctccgtgtacctctgtgaggctgagggtggagtccatttgctgaccccacagcctgcatcctacccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcacttcctcgt

SEQ ID NO: 437659 - DNA, 1134 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagtgagtatctaacggatgc

SEQ ID NO: 437660 - DNA, 1671 bp, Homo sapiens
gagctcctgcagcagagggtcccgtgtctgtgctactgaagtctacgcttgtgctcgatccggttgcttctcgttagatagtagtgtgactacgagatgccctgctgagtgtacccgtccgcattatggaatcctcttccatatattggtcctgaataaagagaggatataaggagaagaagctgaatttgtttgagtgttgagccatgaagcgtaaagaggagaatacttggaacaataacagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437661 - DNA, 1634 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437662 - DNA, 1022 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttgggcgcctaagtggaactgctccgtgtacctctgtgaggctgagggtggagtccatttgctgaccccacagcctgcatcctacccagatgtgtccagctgcagggggagcctcaggaaaaccggctgctgctactcctgtgaggaggactcctgtcaagtccgcatcaacacgaccatcctgtggcaccagggctgcgagaccgaggtcaacatcaccttctgcgagggctcacttcctcgt

SEQ ID NO: 437663 - DNA, 1267 bp, Homo sapiens
agttagtcttgaagacatcagtattttcccatttcatggtctgtcattttgtattagaggagagtaagacactgtataaatggtattttgcaacaaagtataaacctttgggttgtatgttttctgttgctttatagtttaaaatggaatggacaggaacgtttttagaaatatgcaaatacatgctctcagtggataggcttacactttggcaaaagtaacctaaatccaagcggtcatgaaccgttgagaattgtctcttctctggagacactgagctggaacctggtctcgctgtgcagtgggtggcaggcagcctctgccttttgattaatcatgtgcagctgtctccacacactgcagagacgctttctgcattttgtctctattgcgctctcgaaaatttggcaaaataatgcatttcatttgcaggtggaagtgagttggtcatctacatttgtggataaagttattgtcatgagactcatttcttcaaagcatttcacagatacgatgaatgacagagtgcattccttcctcaacgacattggctttgtttgcctcctcagttaaatcaaggtgtgaaacaaaccaggagaaaaagaaagattatttaaaatgaggccatcagtatcaggaatgagaagaacagctgctgtgcaaactccagcacttgtgtggcgttgtttacaggacagaaatcttgcttctgtaagttgtggaaagttaacgtgatgttaaccttgtcggaccttgtttttgttctgcacccctcctttgcttaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437664 - DNA, 437 bp, Homo sapiens
tggccttttctagaaattgcccacagcttgcaaaaaggctgtgttccctggccccggctgcggctgtgtaggagtctgaatatcattttccccagaagttgagggtgaggccggcagccaggcaggaaggcagcaggaggaggaggaagcggaggcggcaccttctgagaggcgcatgctcagtgagtcgtgaagatggcagggctggcggagcggccgcatctgatctctcccctttttttaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437665 - DNA, 1736 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437666 - DNA, 394 bp, Homo sapiens
  misc_feature (47)..(48): n is a, c, g, or t
  misc_feature (50)..(50): n is a, c, g, or t
  misc_feature (56)..(56): n is a, c, g, or t
cgccaggaggggcccgcccggggccggacccgtatagtcttaaaaanngngtttcngtggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437667 - DNA, 1733 bp, Homo sapiens
aaagataaaatctcaaatctggctagttagcaggtatgtctccatggttccgcggtcgggcagatatgggagtaaggacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaatttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437668 - DNA, 1970 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagatgttttcaaggccaaaaacctaattgaggtaatgcggaaatctcatgaagcccgtgaaaaattgctccgtcttggaatttttagacaagtggatgttttgattgacacatgtcaaggtgatgacgcacttccaaatgggttagacgttacctttgaagtaactgaattgaggagattaacgggcagttataacaccatggttgggaacaatgaaggcagtatggtacttggcctcaagcttcctaatcttcttggtcgtgcagaaaaggtgacctttcagttttcctatggaacaaaagaaacttcgtatggcctgtccttcttcaaaccacggcccggaaacttcgaaagaaagtaggaagcccaacagatcattgagtacactggcctgatagaaaagttaaaataggtggcttatttgtgaaaagaaccatgacagaatcagctgccacttctgcagtgaccacatgctgtagatttcctcttgaagatgagccctacgggcgtagtgttaagtctgttgatttaaatgtgtgcaagttctaatcactgtttcagcttttaaagctctatcccattgtctcctagtttctctgtaaacttatataaagttactggacagttcccttggagctcactgcgggagacggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437669 - DNA, 977 bp, Homo sapiens
taacggctaggtaggaggctgggtgttgaatcggccgaggggacagaggaatgtcagctgagtacagttttcccatatggaagaccagccacactgtcaagtgggaaggcgtatggcgagaactgggctgcctctcaaggacggcgtcatttgctgttcgaaaagaaagcggacattcactgaaatcatctctttcgcacgccatggtcatcgattctcggaattcttccatcttaccaaggagaggtgctttgctgaaagttaaccaggaactggcaggctacactggcggggatgtgagcttcatcaaagaagattttgaacttcagttgaacaagcaactcatatttgattcagttttttcagcgtctttctggggcggaatgttggtacccattggtgataagccgtcaagcattgctgataggttttacctcgggggacccacaagcgtccgcggattcagcatgcacagcatcgggccacagagcgaaggagactacctaggtggagaagcgtactgggccggcggcctgcacctctacaccccattacctttccggccaggccagggtggctttggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437670 - DNA, 776 bp, Homo sapiens
agccgagggggcgcggagaaggcggggaatcatggccgcccccagtgttccgcgtccgggggtttgtgggagttgccttgacctgcagctccgccaccgcggacccgccttctgccctcagcagcagacgctctgtcccgcccgggcagctctgcgaggcagcggctggagagggaaccatggggactgtgcacgcccggagtttggagcctcttccatcaagtggacctgattttggaggattaggagaagaagctgaatttgttgaagttgagcctgaagctaaacaggaaattcttgaaaacaaagatgtggttgttcaacatgttcattttgatggacttggaaggactaaagatgatatcatcatttgtgaaattggagaacttttccgaacacacttctttctcaacgcaggaaacctctgcaacctcaactatggggagggccccaaagctcatattcgtaagctggctgagtgcatccgctggtcgtacggggccgggattgtcctcaggcttggcaacatcgctcggttggaacttaattactgcgtccccatgggagtacagacaggcgacaggatatgtgatggcgtccagtttggagctgggataaggttcctgtagccgacacccctacaggagaagctctgggactggggcagcagcaaggcgcccatgccacacaccgtctctcgaggaaacgcggttcagcgattctttgactgcggaccctgtgggaaaccccgtcaataaatgttaaagacacactcc

SEQ ID NO: 437671 - DNA, 2840 bp, Homo sapiens
cggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgattagagtacctttaattttttccaaatgcatttatttctgttcataaaataaaagtttaaaatatctttcctattctgtaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttc

SEQ ID NO: 437672 - DNA, 1698 bp, Homo sapiens
cggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgattagagtacctttaattttttccaaatgcatttatttctgttcataaaataaaagtttaaaatatctttcctattctgtaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctgtaattccagcatctgggaggccgaggcaggcggatcactgaggaggagtcgagaccagctgggcaacaggcgaaaccctattccccaaaa

SEQ ID NO: 437673 - DNA, 2755 bp, Homo sapiens
cggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttc

SEQ ID NO: 437674 - DNA, 2808 bp, Homo sapiens
  misc_feature (2769)..(2769): n is a, c, g, or t
cggggaagtcgcgcatgcgcgagtgtacgcgttgccggcgaagaggggagcctgacgactcggaaatttgaataccacagtagcatggagtgtgacctcatggagactgacatcttggagtcgttggaagatctaggttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtccgagtgaagctgaagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaattaaaggaaacattagcaaaagttccacctaatcatgtgggaaagcctttactgaagaagccaatgggaccagcccactgggaaaagatagaagcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttcaaaaaaaaaaaacnacactcttctaactaattaaacaatctataaaatctaaa

SEQ ID NO: 437675 - DNA, 725 bp, Homo sapiens
caaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437676 - DNA, 1596 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437677 - DNA, 995 bp, Homo sapiens
  misc_feature (841)..(841): n is a, c, g, or t
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtcacggtccantgactccggtgtggcgggaacctgttccctggatgcccctattggcggtctgcacataagggtggcccaaaaattctgttgtggtccgccctctttttgcattaaagtcccccaaggggcgtgtggggcacatatacacacaaagattaaatcg

SEQ ID NO: 437678 - DNA, 551 bp, Homo sapiens
caaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437679 - DNA, 687 bp, Homo sapiens
  misc_feature (51)..(51): n is a, c, g, or t
ggaggatggcagagcaggtctcggggtgcgtggggagagggtcggtggacnagggcaggtcaagatgccgatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcccatgtgtgctcagtatttaactctcacttataagtacgaacatgcggtatttgattttctcttcctgcattaattcgcttaggattatggcctccagcttcatccattttgccgtaaaggatatgattttgtgctccatttttaaaaaataatagctttattgagatataattcacatatcatacaagtcacccatatcaaaggtacaactcaatgttttttagtgtattagcagttgtgcagccatcaccaccgttttctacatttttatc

SEQ ID NO: 437680 - DNA, 2162 bp, Homo sapiens
  misc_feature (1621)..(1621): n is a, c, g, or t
  misc_feature (1625)..(1625): n is a, c, g, or t
  misc_feature (1628)..(1628): n is a, c, g, or t
  misc_feature (1633)..(1633): n is a, c, g, or t
  misc_feature (1644)..(1644): n is a, c, g, or t
  misc_feature (1646)..(1646): n is a, c, g, or t
  misc_feature (1651)..(1651): n is a, c, g, or t
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttaanaaanaanaaaanaaaaaaaaaananaaaanaaaaagggggggggcgcccaaaaaacccccggggggcgccatccccccccccacttttacatggaaggaggggcccccccataggagggcggcataataataaaacggaacgagcaggagggcgcggcggttaaaacacaagccggctgggagggggacacaacgctgcgtgtggcggcactgggagaagaagcccccaccattcgtggggggccggggagaacaatatggggagcccacaccccaccaaggaggataagaaccgccacgggggggaaaaaacacgggcgcggtggagggggcgggcccccccccgcgtataatatcgtgcgcgcgaaaaactttcggccaaccgaggtatgtttaagaaatataacggcgcgcgtcgtagtatagaacacagggacagcacgatcagggatgcgacgacaccacgagcacgcacaagagcacagcagagcgcaccacgacaccacacagagcaagaagcacgacgcacagaacagcaacg

SEQ ID NO: 437681 - DNA, 1582 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatacctccgataaagtagcccatgcatctcggggcggtgggtggggtgcgtggg

SEQ ID NO: 437682 - DNA, 2308 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 437683 - DNA, 1770 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437684 - DNA, 2123 bp, Homo sapiens
  misc_feature (1582)..(1582): n is a, c, g, or t
  misc_feature (1586)..(1586): n is a, c, g, or t
  misc_feature (1589)..(1589): n is a, c, g, or t
  misc_feature (1594)..(1594): n is a, c, g, or t
  misc_feature (1605)..(1605): n is a, c, g, or t
  misc_feature (1607)..(1607): n is a, c, g, or t
  misc_feature (1612)..(1612): n is a, c, g, or t
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaaaaaaaaaaaaaaaaaaaaaaaaaaaaaaaaaaaaaaanaaanaanaaaanaaaaaaaaaananaaaanaaaaagggggggggcgcccaaaaaacccccggggggcgccatccccccccccacttttacatggaaggaggggcccccccataggagggcggcataataataaaacggaacgagcaggagggcgcggcggttaaaacacaagccggctgggagggggacacaacgctgcgtgtggcggcactgggagaagaagcccccaccattcgtggggggccggggagaacaatatggggagcccacaccccaccaaggaggataagaaccgccacgggggggaaaaaacacgggcgcggtggagggggcgggcccccccccgcgtataatatcgtgcgcgcgaaaaactttcggccaaccgaggtatgtttaagaaatataacggcgcgcgtcgtagtatagaacacagggacagcacgatcagggatgcgacgacaccacgagcacgcacaagagcacagcagagcgcaccacgacaccacacagagcaagaagcacgacgcacagaacagcaacg

SEQ ID NO: 437685 - DNA, 2056 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccattaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 437686 - DNA, 1797 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccagggtgagccgcttcggactgcgaactaacgcggcttcttagctgctgcctgctctccctgcctcgcctgcgggagcctcccgagcgggagagggccgcaggagcgatttggggaggaaggtgggaggggactcaccaagagagcgccgaggtgggcccaggcctggtgagagagtgtgggggacgatggatggagggaggaagaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437687 - DNA, 1002 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcccatgtgtgctcagtatttaactctcacttataagtacgaacatgcggtatttgattttctcttcctgcattaattcgcttaggattatggcctccagcttcatccattttgccgtaaaggatatgattttgtgctccatttttaaaaaataatagctttattgagatataattcacatatcatacaagtcacccatatcaaaggtacaactcaatgttttttagtgtattagcagttgtgcagccatcaccaccgttttctacatttttatc

SEQ ID NO: 437688 - DNA, 1263 bp, Homo sapiens
caaggaagtggagtctagttttagggtgggcaagtcagcaattacaaaagtgcaattaggtttgagcagaggaagcatgagagcacctaggaaaggagtctttagctttgtcttaaatttcagttatattaattatacagtacccatctcttttccactcctgaataacatctaacatctagaaactttatgaaaatcattattgatttgagcatttttaacattaacttgttgccttagacaccaactctacaacattacctgtcatatactgaagaatctcttcttccagttatgcagcacctggctaagaatgtagtcatggtaaatcaaggacttacaaagcacatggtgagtcaatatagtggcattgtaagatgctgaaaagtgtaataattcaaacttaatgcctgcaaatgcctggtttatttttaatgagttaatgttttaaatgaatacctgtatcattgcatcttgtgattttttttcttttgcctctttaattgctatctttttgtcttccagactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 437689 - DNA, 580 bp, Homo sapiens
acaggttcaaatgaaattcaggttgttgcaggagaccatgtacatgactgtctccattattgatcggttcatgcaggtgagcatttcagtaagagttttcccttccaggattctagccgagtcataagaaactgatgttttcaggccagtctgggcgcagtggctcatgcctgtaatcccagcgggcgggtggatcacaaggttaggagatcgagaccatcctggccaacgcagtaaaaccctgtctctactaaaaatacaaaaaattagccgggcatggtggcgggcgcctgtagtcccagctactggaggcggaggttgcagtgagctgagatcacgccattgcactccagcctgggtgacagagcgagactcaaaaaaaaaagaaagaaataaactgactttttcaactaaaatctttcttgggggatatggtgtcattaagattttgctatgggagaatgtctttctacctctccttcatcatagctctgtgtctccttttcaaacattttattcaccctattgaaattcccattgcagaataattgtgtgcccaagaagatgctgcagctggttg

SEQ ID NO: 437690 - DNA, 848 bp, Homo sapiens
  misc_feature (762)..(762): n is a, c, g, or t
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgagaagagcagcagtcngaccaaatacctaccggtcggaagtcctggaacttggagcctcctatgacggggtcacaggtcctgccggtgtgccgcgccctccc

SEQ ID NO: 437691 - DNA, 2134 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 437692 - DNA, 1692 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagacaccaactctacaacattacctgtcatatactgaagaatctcttcttccagttatgcagcactggctaagaatgtgtcatggtaatcaggcttc

SEQ ID NO: 437693 - DNA, 1638 bp, Homo sapiens
  misc_feature (1428)..(1428): n is a, c, g, or t
  misc_feature (1435)..(1435): n is a, c, g, or t
  misc_feature (1441)..(1441): n is a, c, g, or t
  misc_feature (1443)..(1443): n is a, c, g, or t
  misc_feature (1450)..(1452): n is a, c, g, or t
  misc_feature (1467)..(1467): n is a, c, g, or t
  misc_feature (1475)..(1475): n is a, c, g, or t
  misc_feature (1480)..(1481): n is a, c, g, or t
  misc_feature (1484)..(1485): n is a, c, g, or t
  misc_feature (1491)..(1491): n is a, c, g, or t
  misc_feature (1494)..(1494): n is a, c, g, or t
  misc_feature (1506)..(1506): n is a, c, g, or t
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcagaacagtatgcacatcgaagctgtnagacagntctacncngtgattnnnctagtcagattagcnaggtgggnaggtnntgnnactggnggnatattcaataanggccgggctctgtttaaaaaaaaaaattgggttttgggggaaaggtgaggatgttagtttcgacctttggaggggatgggcctaggggttagactagtgttgaagagagagttaaatattataattacttag

SEQ ID NO: 437694 - DNA, 1544 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaa

SEQ ID NO: 437695 - DNA, 1309 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatgggtaagctgtgtcccacagaactcc

SEQ ID NO: 437696 - DNA, 1975 bp, Homo sapiens
cgccaatgggaagggagtgagtgccacgaacaggccaataaggagggagcagtgcggggtttaaatctgaggctaggctggctcttctcggcgtgctgcggcggaacggctgttggtttctgctgggtgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaactctacaacattacctgtcatatactgaagaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggccccttttacttttttatagcttaactaatttgaatgtggttacttcctactgtagggtagcggaaaagttgtcttaaaaggtatggtggggatatttttaaaaactccttttggtttacctggggatccaattgatgtatatgtttatatactgggttcttgttttatatacctggcttttactttattaatatgagttactgaaggtgatggaggtatttgaaaattttacttccataggacatactgcatgtaagccaagtcatggagaatctgctgcatagctctattttaaagtaaaagtctaccaccgaatccctagtccccctgttttctgtttcttcttgtgattgctgccataattctaagttatttacttttaccactatttaagttatcaactttagctagtatcttcaaactttcactttgaaaaatgagaattttatattctaagccagttttcattttggttttgtgttttggttaataaaacaatactcaaatacaaaaatatcttttttaaaaa

SEQ ID NO: 437697 - DNA, 7520 bp, Homo sapiens
  misc_feature (4088)..(4088): n is a, c, g, or t
  misc_feature (5487)..(5487): n is a, c, g, or t
  misc_feature (5701)..(5701): n is a, c, g, or t
gacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437698 - DNA, 5602 bp, Homo sapiens
  misc_feature (2170)..(2170): n is a, c, g, or t
  misc_feature (3569)..(3569): n is a, c, g, or t
  misc_feature (3783)..(3783): n is a, c, g, or t
ccgtcgcgtgttcaagctggaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437699 - DNA, 4613 bp, Homo sapiens
  misc_feature (29)..(29): n is a, c, g, or t
  misc_feature (48)..(48): n is a, c, g, or t
  misc_feature (1181)..(1181): n is a, c, g, or t
  misc_feature (2580)..(2580): n is a, c, g, or t
  misc_feature (2794)..(2794): n is a, c, g, or t
tggtttcagacaggaagaagggggcagtnttggataacccagaatgangtcatctcaaagtcatcatgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437700 - DNA, 4179 bp, Homo sapiens
  misc_feature (747)..(747): n is a, c, g, or t
  misc_feature (2146)..(2146): n is a, c, g, or t
  misc_feature (2360)..(2360): n is a, c, g, or t
ctgtcagatctgaatggaaaggtcactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437701 - DNA, 4156 bp, Homo sapiens
  misc_feature (724)..(724): n is a, c, g, or t
  misc_feature (2123)..(2123): n is a, c, g, or t
  misc_feature (2337)..(2337): n is a, c, g, or t
tgtcaggaaagtgcacactgttgttacgtggagtaaaaccatcagagtcaaggaaccaacaccaccatagcccagctgcttcttttaagaggctgtgaacagaggggttcccaacagagaacatacacgctcatcttctgaacttggacaatgatcaaagacttctcctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437702 - DNA, 643 bp, Homo sapiens
tccacgtcgtatttggtcaaaatactgtctgtgtcctttgatcacacacaccccacccggcacacccacagctaaacagaattcttcattagaggaaatagcagttctgttcaaaatctccgcaaaagctggtcagaaaactcgctatgaaatcacaaagactgatccaaagagctgagctgctacgctcactccattacagtacaatgttatgtcgggaacacgtgctgctaactcactggtgagttcaatggcaacgcttcattcgggaggctgttctgctttacgcatctgaggataacacgttcgcgaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437703 - DNA, 3913 bp, Homo sapiens
gacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatg

SEQ ID NO: 437704 - DNA, 5230 bp, Homo sapiens
  misc_feature (1798)..(1798): n is a, c, g, or t
  misc_feature (3197)..(3197): n is a, c, g, or t
  misc_feature (3411)..(3411): n is a, c, g, or t
caacagcctgtgaagagcagctctcctggcagcgtccctgactggcgcatttctgacggctgcccacgggccgcactggtcacctccaactccaagcaggattttacccccaccatcccaggccgggctgatgtctgttctcacactgcttcctctgcttccaggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaangaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacntaatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttnacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttctttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaatttaaaactctgcagctacaggttgacaaagtttctttgtaatgctctcttgagaagc

SEQ ID NO: 437705 - DNA, 4134 bp, Homo sapiens
gacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgtgtttgtagttgctgctaagcgaacgccctttggagcttacggaggccttctgaaagacttcacagctactgacttgtctgaatttgctgccaaggctgccttgtctgctggcaaagtctcacctgaaacagttgacagtgtgattatgggcaatgtcctgcagagtcttcagatgctatattttggcaaggcatgttggtttgcgtgtgggaatcccaaaggagaccccagctctcacgattaataggctctgtggttctggttttcagtccattgtgaatggatgtcaggtaactttgtgttaaagaagctgaacttgttttatgtggaggaaccgaaagcatgagccaagctccctactgtgtcagaaatgtgtcgtttgatccgcatacg

SEQ ID NO: 437706 - DNA, 2637 bp, Homo sapiens
tgtgtaatatttctattataaggacagatattgacccttgcatttcataatttttaaagatatttaagctaaaattttctcagccacatttttatataaaaccaaattttatgtaaaaactaggcttcaataagttagctaaattttttaaattgtaagacaaaatttttatggaaaagaattcctatatcccatcaaacctaataattttccacaactaaaaatgagtataaatacataattttaagtgcatcctgtcaggtctgatatttaattttactttagttagaagctaagtagttaccctgttacttcttcatggatgctaacagaagacttgagattcccagacagaaacaaaggactattactcatggcacaacaaggagcatgagcatcagcacattctcattgcttccccttgtcccaggtcccatgggggcaaaatgatatggccatatgcaatatggctacatatacagcaggcttttgttgtaggtaaagaatactgagcttggagggttcactgctttttatccatgaacagaagcaaacctgctctttgcctcatcccttatagatgctcactcaaaactcaatactgagaaatggcccaggtaaagaacagccaaggtctttcatgcttgccacacccagcaatatgtttaggaaggtgaagtctactgagggctatctcacatctaacagtttctttactaggaccagagaccattttggtaagatgcagataacaaccccaaccttaacaacttcacaacatgaatagaaatagtgataaataattcatagctttttacaaaagaataatgaggtataataggaaaatgttttgatgccaaaaataaaagagttaatgtttggatcggactccaacagggctccttagagtgatacaaatacaaagcaaacgatatgtgtaatttaaaatttcctagtgcacatgtttttttatttttctttttcgagatggagtctttctctgtcgcccaagctggagtgcagtggtacgatctcagctcactgcaacctctgcctcctgaatttaagcgattctcctgcctcagcctcccaagtagctgggattacaggcgtgagccactgcatctggccctgtacgcacatttttaaaaataaaactttaaaaaagaaacagttgaaactaattttaataacattttatttaaccaaatatatcaaaaatattatttcagcatgtaatcagtattttttaaattgagatatttgttttatcttcaaaattcagtgtatatttttacataatagcacatctcaattcacatgctaaattttcatcagaaatattttatctgtatttaaatttcctaaaatgtacagttgaaaaaaagagattcacatacccaggttgttctagcatgcctaaaaaatcttgtaactggatcaagtatcagtttttaaattagttaaaattaaataaaatttaaaatttagttcctcagtcacactagccatatttcaagtacttgaaggccacaaatggcttgagactaccttgctgaacagaccaaggtcaaacactgagataataatgattcttaaggccatttgaaagttaacagcaagtatgtattactgctatctacagtaagaattacattttatctacaggcaatcataagccatgtctgttatgcagcataggctttccattctctatacatctaggtcatagagtttttccattgataaatctggatgtttatataccaacagtactttcttacaacatattccagtatatagtgtccagcttcacccactttttaaagtggccctgaaacaattttattcatcttattggagtgttgctgtaggggaagagtagaagctaagaagagtttgagttcaacaccattatatccaaatcctgaccttactactggaatgtaagctccttgaaagtggagatcttgtctgtcttgttcacagttgtgttcccagccccagaggtagtctcagggccaataccaagtatgctctcaaatatttgctgggaaaatttactagctggataaaaggcaagttactttaatctctttaatcttcctttgtccttacaaatgaaagagactaatagtacttaaccttgcagtgttattataaggattaaagttgataaatatatgatcatgagaacaattgctagcacataacggtcactctgaaaatagtagctgatatatcagctgcattgtttgattattgttggctcaattaaaagttggcttttccaaatcctccattaggaagaatttttaaatagccatattgaaaataaagttgtcagaaaaccaatgtaacatatgttgaatttttattaccaaaaagaagttactatccagttgtacagaaaagtagaatgaggttgtgcatcaagaaaaaaattgttcgttctcaacaaaaatttaatcacatgggtagtttttttttttttagctatgggttcatgctgtatttggttgcatcatatttgataaagaagcttccaacttagcatgaaatacctaaagacaattttttttttaagttagtaggcactttttagaatttccaggaacttttaaagatgttgtctcc

SEQ ID NO: 437707 - DNA, 364 bp, Homo sapiens
gaaataaaattaggaatcaatagaacaatgacaaaagagatctccacacgcacaccttagagagtaaaatcatacctctaaagcattatccagcaaatgttatatgggatgcagcaaagaagtacctagaggagatcttgaagctttaaacgcttctacagaagggagaaaagttaaaaatgaactaagcattcaactgaataaattcttttttaatttttttaattatactttaagttctaaggtacatgtgcacaacatgcaggtttgttacatatgtatacatgtgccatgttggtgtgctgcacccattaactcgtcatttacattaggtatatcttctaatgctatccctcccccctcc

SEQ ID NO: 437708 - DNA, 1342 bp, Homo sapiens
ctgggaggcggcgcttgcagtgagctgagatcgctccactgcactccagtctggatgacagagcgagactccgtctcaaaaagataagaaataaaaaaattttaaagtgtaagcatctcagatgccttgcaggaatgtgggataaagtgctcagaatgttccctggcagatagtataggcttgttttccgtgaagagcctgtaactgccacttggttccccttccacccctgacattaggaaatagttgtgcaatggttgttactctcagggtggtcacttaggcaaactccagaggagggtgtacttccactgattatccttctagcccctttcccccaaatccccaaggaaggctgggaatcatcaaaatggagttggcctttacttgtcaacaattgagtaaatcctaaatacggacgaacacccaagtagctcctgaattacaattaaaggaaaaacatttcttaaaatggaaggtgtatgtactttgtagcggatattctgtaatctcagtcacagggccatgtcttactctatattgctagtgtctggcccttgagaccagcttgttgctcagattggacacagacagcaacactgccactgactacctgggtgagaaggtgggcaagttagccagcctctctgggcctcagatcttgtgtaaaataggtataacacctaccttacagggttattttcagaaattaaagatagtatatgtaaatcactcagcatatatagtaggagctgtttaaagtattgtaaatattatgtaataattgagtatattcttggtattctgtggtaagcttaaatttaagaggctttattctgtgatttgagcatcattctttgctggtgaagaaaagaagacaaggaattcatttaatatttgagtgcttacctacctgaagcatagcattgaaccagatggatatatagtccctgctgctaggtgagcaaaaataagtattaatacttgtgcctcttctgcctgtttttcaggtagaaaaaaacccagtgcccctctttgacattatttaaataagatttctcctcaatataacagtatagtgacattaactatgttttttcaaatcatttcttaccaccaccaaaaaaaaaaaaaaaaaaattttgtaccacctgtgggcattccaaccccctccttcccaagtataggaaaacactggatgagttgggtcctggtacctgtagtcccagctactcaagaggctgaggggtgaggatcacttgagcccaggaatttgaggctgcagtgagtcgtgatcacatcactacactccacaccgggtgacagagtaagaccctctcta

SEQ ID NO: 437709 - DNA, 536 bp, Homo sapiens
tcgacatgctatgcttcaggtaggtaagcattgaaccagatggatatatagtccctgctcacctagcagcagggactatatatccatctggttcaatgctatgcttcaggtaggtaagcattgaaccagatggatatatagtccctgctgctaggtgagcaaaaataagtattaatacttgtgcctcttctgcctgtttttcaggtagaaaaaaacccagtgcccctctttgacattatttaaataagatttctcctcaatataacagtatagtgacattaactatgttttttcaaatcatttcttaccaccaccaaaaaaaaaaaaaaaaaaattttgtaccacctgtgggcattccaaccccctccttcccaagtataggaaaacactggatgagttgggtcctggtacctgtagtcccagctactcaagaggctgaggggtgaggatcacttgagcccaggaatttgaggctgcagtgagtcgtgatcacatcactacactccacaccgggtgacagagtaagaccctctcta

SEQ ID NO: 437710 - DNA, 1763 bp, Homo sapiens
tgggaaaaagatgaaacctggaaatctgggaaacttaaaattttcaacaccatttataaatataaaaagcctctggttacttgagtgttgcacatttagatatttgattttgtatgttgattacaaatggagttgtggccttgcaaaccatcacaatcatcattataatcattgaatttatggttcatatggcagtttcttatacattattcaatttactttaatcctcttaactctgtcaagtaggtattaccattaatcctcattttacagctgaggaaacaaggtagaaaaggtgacttactcaagatcccagagctagtaacctcgaggttttgttttgctctttggttttgttttcaatttaggtaatgagctaccaacattagaatgatgcatagaaaggtgctgggccatggtctttgcatcttccaataaagcataataagatatattaatttccaggaaaagagttgagggagaaaaaagggggaatatgatttattgatacaacttttagggaaatttgatcagcgtagtattccaagctttattttgatcattttcaaaccaaagtttaatctgttaaaatagacatgcttcttttactctgtgtaaacatgaagctccacatattacaagagggcttggaaggatgggcctactaattggtacagagcaacaaagtctattttttatttaaagatataggtgttttaggaaggagaggggatgttaaagatagtatttggctgtatgaaaatatagaagtatgagactggcagctctgtagagggctttgggtgagagaatacaaaggagagaaaatgagaaagacattgttgtatgaatataagataaaccaccccagttaagtgcaggctctggatgaagtatttctattacaaatgacagagctgggacagaagcaatgtagactgttgatgcagtatctcgaggggagtttgcacactggatatgtaaattattattgtttaaagatattcttccatcttggggaagttgcttaacctatattatttgcatttttcttatttgcaaaatgggactaaaacagtacagttcttaccatatgtaatctttgagagtattaacaaaaaaaagtatgtgaagtgcctactacagtgcttgtcataaagaaggctgcagtggatatggcaacactttcctccatcaacccccacccccaaattcctttcagttatgaaaattctgaaacactgtaactttacctatatatttattggatatctacttttcgaaaagtagaacatgtgaagaattcttgatttttccttggagatacctttgcaagttagaggaagatattagtgcctgtcttccttggtttaattttaattcaaaagaaagatatgattgagaaggtaggagaaatgactgactagttcatctaggcattaatagtcctaaaagagggaactgtaaggcaaccagacacatggcctcaattttttaagaaggcagatttaaaaataaatacatgcataaataaaattttaaaacaaaaccagaaaaaatggtagacgaattctcatgatcaaatttactaaaaagaatatggctttaaaagatgagtctaggccaggcatagtggctcacgcctgtaatcccagcactttgggaggctgagttggggaatcatttgaggtcaggagttcgagaccagcctggccaacatggtgaaaccccatctctactaaaaatacaaacattagctgggc

SEQ ID NO: 437711 - DNA, 1917 bp, Homo sapiens
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcaggtgagattaggggttgggaaggaaaatcccttttcccccagtggcctagggagtttccaaatggacctcagaccttgggatttggcatgtgttttgtgtggggcttccctaagcataaagatgtgcctttatgagggcaaagtgtt

SEQ ID NO: 437712 - DNA, 1415 bp, Homo sapiens
  misc_feature (1340)..(1340): n is a, c, g, or t
  misc_feature (1347)..(1347): n is a, c, g, or t
  misc_feature (1350)..(1350): n is a, c, g, or t
  misc_feature (1353)..(1353): n is a, c, g, or t
  misc_feature (1360)..(1360): n is a, c, g, or t
aaacagcatcaccccaagatgaggacaccccttccctagaaaggtgatggaggcaccccgaagcccaggatggaagctgtgaggtctggatgccacatctgcactccaccttgacaggaggcctagccctagacctcagacccgagagctgcaggggttgtcccagcgggtctggaactcccacctccactgttgacccagatctgcagctgggacagcagtactcctacctgccctacctgtgctcccactggtaaggtaggggaaggaaaggcccaggtggtagacatcccaggctgagggtgggatcccaaaagggctctctgaggggttgggtttctcaataaggtactatttcctgaccttctctcctgagacaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacaggtatggcgatgagctacaacatcacctgagtcaccagagttgggttggcagaggggtgaagggttcaccccattccctgacccatccatgctcttcctggccttttagccctgggttcctcatgccttccagctctgctcctggtctactccttagcccacaccctgtgggttcagcagctggcttccttctaacgtctcattctttgtttctccctttcttttgctgaactccctgtccccccaaccccagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagattttntgccctntgnacnaatttcntacgttttttcccccgtgtgatgcctgcatgggggggtcctgtaggggggtccca

SEQ ID NO: 437713 - DNA, 3108 bp, Homo sapiens
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgctgcttcctgctcagcactggggactatgcctgcgccgatggtagtgtccggaaagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 437714 - DNA, 2205 bp, Homo sapiens
aaacagcatcaccccaagatgaggacaccccttccctagaaaggtgatggaggcaccccgaagcccaggatggaagctgtgaggtctggatgccacatctgcactccaccttgacaggaggcctagccctagacctcagacccgagagctgcaggggttgtcccagcgggtctggaactcccacctccactgttgacccagatctgcagctgggacagcagtactcctacctgccctacctgtgctcccactggtaaggtaggggaaggaaaggcccaggtggtagacatcccaggctgagggtgggatcccaaaagggctctctgaggggttgggtttctcaataaggtactatttcctgaccttctctcctgagacaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacaggtatggcgatgagctacaacatcacctgagtcaccagagttgggttggcagaggggtgaagggttcaccccattccctgacccatccatgctcttcctggccttttagccctgggttcctcatgccttccagctctgctcctggtctactccttagcccacaccctgtgggttcagcagctggcttccttctaacgtctcattctttgtttctccctttcttttgctgaactccctgtccccccaaccccagaaggcaatgttgagccgaaagcgtgcgtcccagtgtctcacacctgtgctctttaaacacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 437715 - DNA, 3247 bp, Homo sapiens
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgctgcttcctgctcagcactggggactatgcctgcgccgatggtagtgtccggaaagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcaaaaaaaaaaaaaaaaaaaaaaaaaaaggggggggggaaaaaagtatatcccccgcggggggcccaagagatacggggaaaccagagatattctgtggtgccaagggggccccataaggggagaccgaatatacaaaagatcaggacacgggcacagggataaaaaacgggtcggagaccgggagaaaacgtggcacaccggggcacacacggcgacacgcgacccccaaacctcccgggcgggggacaccataaactgggaccaactataaccataaaaaacataaccggcaccaaccgggcaaacattctaaacatttacaaagatgataacacagtggtgttcaaccaaataggaggaaataaataaagaaaacgccgtgaaagcagattggggcgaacaagtgaaattcgcacatgtcgcaacacccttttcataccccagggcactgagggaggcaacaaaaaagaaaggcacagacccaaaaagaagagaaagaagacagagaacggaagaaggaagacaacaaccagagaagcacgcggagagcacagaccacgaaggaagacgaaaagcaggaagaagacgatgagacaacgagcacccagaagacagcggaaacaacaagcaaacgacaagaagcaaagacaaaaacgaaccgacgaggccagagccaagaaaggagaagcgacacgacaagcagccggcaaggccgaagacacggaacaaacggcgcgagaaacaaagagacgagaagagacacaaaagagaaacaacggaaaaaggagcgacaagacaagggaacaaacgagaagaggacggcgagcgcagcaaacagagaagacggcaaagacgaagcaggccggagaaagggcggaacaaggagagaaaaacgaagagaaacaaagacgaggaggaggaagaccaagagaagaaacaacgccgcaaaacg

SEQ ID NO: 437716 - DNA, 2272 bp, Homo sapiens
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgctgcttcctgctcagcactggggactatgcctgcgccgatggtagtgtccggaaagggtatggcttcccaagctggacaggtggggagcccccacagagctgagtctcccgagtcccccaccaagagcctgaggtccccccctcccctgagaccgtggccgccatctcctctgccttggatgcacccccacttttagaatgggtacctgatctcccagtccctggattagaaaggtcttctccatctcagaagggcacacggctcccatccagctgcccatgggaaagagcagcgctagagggtaaagggtgcacaaggccagggtccctgccccgtgcttccattgcatctct

SEQ ID NO: 437717 - DNA, 2030 bp, Homo sapiens
aaacagcatcaccccaagatgaggacaccccttccctagaaaggtgatggaggcaccccgaagcccaggatggaagctgtgaggtctggatgccacatctgcactccaccttgacaggaggcctagccctagacctcagacccgagagctgcaggggttgtcccagcgggtctggaactcccacctccactgttgacccagatctgcagctgggacagcagtactcctacctgccctacctgtgctcccactggtaaggtaggggaaggaaaggcccaggtggtagacatcccaggctgagggtgggatcccaaaagggctctctgaggggttgggtttctcaataaggtactatttcctgaccttctctcctgagacaggcacattcgtcctccgtgaccttccccttcagcattcacctgaggctgcatgccctccaactgctgggactctgttcctgccacattgaggaagggggctgggcacgacatggcatcatactcaggagccttcttcaccagctccttgggacaatggaatatcccagggtggtgacagcagatggagctacttgggggagagctcaagttggtcaggcaacagctggggtgatggcctgtgagccacaggccacatcaggaactttccccactgcctccatgcaaggctgcagagctatggtccctttctccactgcactggagctttgaagacctaagaggctagtggttcctggagctagtggttacctgaacagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcaaaaaaaaaaaaaaaaaaaaaaaaaaaggggggggggaaaaaagtatatcccccgcggggggcccaagagatacggggaaaccagagatattctgtggtgccaagggggccccataaggggagaccgaatatacaaaagatcaggacacgggcacagggataaaaaacgggtcggagaccgggagaaaacgtggcacaccggggcacacacggcgacacgcgacccccaaacctcccgggcgggggacaccataaactgggaccaactataaccataaaaaacataaccggcaccaaccgggcaaacattctaaacatttacaaagatgataacacagtggtgttcaaccaaataggaggaaataaataaagaaaacgccgtgaaagcagattggggcgaacaagtgaaattcgcacatgtcgcaacacccttttcataccccagggcactgagggaggcaacaaaaaagaaaggcacagacccaaaaagaagagaaagaagacagagaacggaagaaggaagacaacaaccagagaagcacgcggagagcacagaccacgaaggaagacgaaaagcaggaagaagacgatgagacaacgagcacccagaagacagcggaaacaacaagcaaacgacaagaagcaaagacaaaaacgaaccgacgaggccagagccaagaaaggagaagcgacacgacaagcagccggcaaggccgaagacacggaacaaacggcgcgagaaacaaagagacgagaagagacacaaaagagaaacaacggaaaaaggagcgacaagacaagggaacaaacgagaagaggacggcgagcgcagcaaacagagaagacggcaaagacgaagcaggccggagaaagggcggaacaaggagagaaaaacgaagagaaacaaagacgaggaggaggaagaccaagagaagaaacaacgccgcaaaacg

SEQ ID NO: 437718 - DNA, 2277 bp, Homo sapiens
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgctgcttcctgctcagcactggggactatgcctgcgccgatggtagtgtccggaaagagacctgccaagacgccctctcgtccaactatgcccaggctgaagtcctcaccctctcttaaagcggcaccaacgtgagagagacaggcagacagacagaaagccagaggcttagggaaactctggaacccagacaagaatcttttcgctgggaaagactcagatatccttgtttgcacaggactggtggaaaatctcccatgcgaccctcggggcccagagccatctgggtctgatgttctgttccattgtacatcgaagagatatatatgcacatatagtatctatattcatacatattatactcttgtgtgtagtgcacgtgctattggtggtttgtcttctttgttaggctgtgtctccctaagcccttgccccacccagagtttcccgtccccttcactgatttctgttgtttctgctgactgtgtgggtggaatgtcccaagaaaagtgcatctgggaattgccagtccagctgggtagtcccaggctcctgtcttggggatgtttcccctgtcagcaagtaacctggtgaagtctattgaaggccagactgccccctagggtcactgcttcactagccgcaccccaccccagattggggttctacctcccaccccacatcctcgttgtggggggacttccaggggctcctctgcagcctcctccactacttcctccaccccatctatgtccttgacttaggggggcattttgtcttttttagatttgattttgttctctctcctttgtctgtttgttgtcaaagatgctgctgggcagacaggcagggaaaggatctgtctgcccatctggcccagggggtccgagaagggaagccttgggcaagaggagaccagttgcaatactgtacttcctggtcagtggccagaggatgcgtgcaatagcagaggccaggtgaccccttcagccttggcctctgcccctcccttggccctccctccctgctcctccctggtgttggtcagtccttttctaaagctgtcccctcgtgtgtgtctggggcatgcccaggctgggccctgtgccctgtctgcatgcctccaactgtcatgctgtgctcgagccccaataaagacatctggagcatcctgctgctcctgctgtgtga

SEQ ID NO: 437719 - DNA, 2078 bp, Homo sapiens
  misc_feature (1977)..(1977): n is a, c, g, or t
  misc_feature (1981)..(1981): n is a, c, g, or t
  misc_feature (1983)..(1983): n is a, c, g, or t
  misc_feature (1988)..(1989): n is a, c, g, or t
  misc_feature (1993)..(1993): n is a, c, g, or t
  misc_feature (1999)..(1999): n is a, c, g, or t
gggaggtggttggggcaagcccaagccgcagagggggccgccaccgcctcctgcctcctcttcgtctcctccccctcccccgtctgacgctgcctcctcgggaagggtgtttggagggcagcggccgccccaagccggagacccgcagcgcttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcggcggtgtgggtagcagcggcagcagcggcggcgggggctgcgagttcttcttcgacaggcacccgggcgtcttcgcctacgtgctcaactactaccgcaccggcaagctgcactgccccgcggacgtgtgcgggccgctcttcgaagaggagctcaccttctggggcatcgacgagaccgacgtggaaccctgctgctggatgacctaccggcagcaccgcgacgccgaggaggcgctcgacatcttcgagagcccggacggaggcggcagcggcgcggggcccagcgacgaggccggcgacgatgagcgggagctggccctgcagcgactgggcccccacgagggaggcgcgggccatggcgccgggtctgggggctgccgcggctggcagccccgcatgtgggcgctcttcgaggatccctactcctcccgggccgctagggtagtggcctttgcctctctcttcttcatcctggtctccatcaccactttctgcctggagacccatgaggcctttaatatcgaccgcaacgtgacagagatcctccgcgtagggaacatcaccagcgtgcacttccggcgggaggtagagacagagcccatcctgacctacatcgagggcgtatgtgtgctgtggttcacactggagttcctggtgcgcatcgtgtgctgccccgacacgctggacttcgtcaagaacctgctcaacatcatcgactttgtggccatcctgcccttctacctggaggtgggactgagcggcctgtcatccaaggcggcccgcgacgtgctgggcttcctgcgcgtggtgcgcttcgtgcgcatcctgcgtatcttcaagctcacacgccacttcgtggggctacgcgtgctgggccacaccctgagggccagcaccaatgagttcctgctgcttatcatcttcctggccctgggtgtgctcatctttgccaccatgatctactacgctgagcgcattggggccaggccctccgaccctcggggtaatgaccacaccgacttcaagaacatccccattggcttctggtgggctgtggtcaccatgacgacactgggctacggagacatgtaccccaagacgtggtcaggcatgctggtaggggcactgtgtgcactggctggcgtgctcaccatcgccatgccggtgcctgtcatcgtcaacaacttcggcatgtactactccctggccatggccaagcagaagctgcccaagaaacggaagaagcacgtgccacggccggcgcagctggagtcacccatgtactgcaagtctgaggagacttccccccgggacagcacctgcagtgataccagcccccctgcccgggaagagggtatgatcgagaggaaacgggcagactctaagcagaatggcgatgccaacgcagtgctgtctgatgaggagggagctggcctcacccaacccctggcctcctccccgacccccgaggagcgccgggccctgcgacgctccaccactcgagacagaaacaagaaggcagctgctgcttcctgctcagcactggggactatgcctgcgccgatggtagtgtccggaaagggncatngnctcgnnactncctttngattactgagtgtgcctcatgtggtctgtccgcctggagggtggccacaggttatcaggccttccgccggagatccggc

SEQ ID NO: 437720 - DNA, 723 bp, Homo sapiens
gctgggactacaggcacgtgccaccatgcctggctaattttcatatttttagtagagatggggtttcaccatattggccaggctggtctcgaactcctgacctcaagtgatctgcccaccttggcctcccgcctgtcatccttcttgatcaattaatattaaccagctttcctctgttaagaagacctttccctcttgtcaactgggattgaactacagttcttcctagacaagatgagataaatgtttatttctcttcaatataccaactctttttaacataccaattttgaaaatttaaccaatttggagtagtcatcttcaaaaagtggcacataactttcagtctctctgtatcacagggatttttgtttttttcagaagttttatgatcatttcagtcattctttttaaaatagtcttcatttgtagaagttttagttttacagaaaaattgagtatatactacagtttccatataccccagacccaatttctcctataattaacatcgtatgtttgcatggcacatttattacaattagtgaaaagtattggtacattattaactaaaatccatagcttattcagcctttcttagtttttagctagtgtttttgttttgttttttcaagatcccatctggaataccacattacattttgttgtcatatctccttaggatttcttagctgtgagtttctcagatattcctttttgtga

SEQ ID NO: 437721 - DNA, 3121 bp, Homo sapiens
acctgggtgcgctccgctgcccgccagcccgcctgccgccgcgagccccgcccgcctgtcctctcgcgtcctcttcgcgtgggtcctgcctccgcggcgggagaagaaaatggagcggggggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctc

SEQ ID NO: 437722 - DNA, 2617 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttcta

SEQ ID NO: 437723 - DNA, 3936 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatac

SEQ ID NO: 437724 - DNA, 5375 bp, Homo sapiens
gtttcactgtgttggccaggatggtctcgatctcctgacctcatgatccacccaccttgacctcccaaagtgctgggattacaggcgtgagccactgcacccagcctcgtatgcattctttatcctaccttttcttgatggaagtacaaggttaaggatttatttaggctttaggctatctagtggagctaaataattatggatttgtacattgagtgcccacgatgtactaggtggatctttgaggcaacacaacgaacatgcagggtctctgttggcatagtccactgtctatttggatccattagcattttaggaaatagttgcaaaaaaatatatgttgtaatagatatagaagacacatgttgagcgtcatagacttggaagggatccagttacttgtctttggagaaagtgagaaatgtatatgactgtttcatgaattcagtttacagatttttgcttgaagtttttttgtgtgtttttgaatttcttattacagcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataagtgagttttaggccttggccttcagggtcctggagtgtaaagactagaggaaaggagaccaagaaatcctaaccttacaacttagcaaaaaactgaatcttttttataagggtcagagctttagaaaatttttttaaacctaagctaaacaaagaatggcaaaagaaaatgccacttttatcgaagcctttatttttattacaactgattattttctgttagtgtagaaaactcagtaaaacaggatgtgttctagaaatattgtctaggagatataatcatgttttctgataaattgacagaaaaggaaaaattttgtatattattatagcattgtgtgcagtttgcagttagagccactatggatagtaattgtcattattcttagttgcttatcattttatttagaatttgtgagtttaagcttccattttaaggtaaaatcagttagtttgaacacacaataaataaggttaataaagcttatttattgatcatttctgtccacctacaatcattgccttttgcagggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaaggtactttttacaaatatgtacatttaatcccatttggggtgtgtagtgtgtgtgtatgggtttgtgtgtttatatgtattcatattcttatgggacatgaacccaaggttttctctggatggtggggaaaaaaatgaggtttttgttttttttttctttaatcttatatattttaatcatatgtataagataattttacagtaatatttttaaaacatatgctttttaaaaaatctcaaattgctgaaagttattaataatttgagaatctttacaaatatatgtacattaacaccattatgtttgcagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatac

SEQ ID NO: 437725 - DNA, 3687 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctc

SEQ ID NO: 437726 - DNA, 1912 bp, Homo sapiens
  misc_feature (1871)..(1871): n is a, c, g, or t
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgttgacatttggtcagttgggtgcatcatgggagaaatgatcaaaggtggtgttttgttcccaggtacagatcatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtgatgtcttgatgataagggtgagtanactgaaatcccaaacactgttttgttgcttgttttattatg

SEQ ID NO: 437727 - DNA, 1084 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggttagtagaagaaactatcgtcatactctttgttttctcattgaggtgaaattcatgtaacaaaattaaccattctaaagtggcatttttagtacattcacagtgctgtacaactaccacccatattaaattctaaaatattttcattaccccca

SEQ ID NO: 437728 - DNA, 522 bp, Homo sapiens
tttttaaaatagtcttcatttgtagaagttttagttttacagaaaaattgagtatatactacagtttccatataccccagacccaatttctcctataattaacatcgtatgtttgcatggcacatttattacaattagtgaaaagtattggtacattattaactaaaatccatagcttattcagcctttcttagtttttagctagtgtttttgttttgttttttcaagatcccatctggaataccacattacattttgttgtcatatctccttaggatttcttagctgtgagtttctcagatattcctttttgtgattaccttgactgctcaaatattttgtaggataccgttttattggaatttgatgtttttctcatttttagactggccttatgggtttctagaaggaaaatcacagaggtaaagcatcatttcatcacatcctgtcaagggtatgtactgttaacataatttatgacttgattttgactttgatcacctggctgaggtaatgtttgtc

SEQ ID NO: 437729 - DNA, 3166 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctc

SEQ ID NO: 437730 - DNA, 2903 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacgtggatttatggtctgtggggtgcattatgggagaaatggtttgccacaaaatcctctttccaggaagggactatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctc

SEQ ID NO: 437731 - DNA, 5474 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataagtgagttttaggccttggccttcagggtcctggagtgtaaagactagaggaaaggagaccaagaaatcctaaccttacaacttagcaaaaaactgaatcttttttataagggtcagagctttagaaaatttttttaaacctaagctaaacaaagaatggcaaaagaaaatgccacttttatcgaagcctttatttttattacaactgattattttctgttagtgtagaaaactcagtaaaacaggatgtgttctagaaatattgtctaggagatataatcatgttttctgataaattgacagaaaaggaaaaattttgtatattattatagcattgtgtgcagtttgcagttagagccactatggatagtaattgtcattattcttagttgcttatcattttatttagaatttgtgagtttaagcttccattttaaggtaaaatcagttagtttgaacacacaataaataaggttaataaagcttatttattgatcatttctgtccacctacaatcattgccttttgcagggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaaggtactttttacaaatatgtacatttaatcccatttggggtgtgtagtgtgtgtgtatgggtttgtgtgtttatatgtattcatattcttatgggacatgaacccaaggttttctctggatggtggggaaaaaaatgaggtttttgttttttttttctttaatcttatatattttaatcatatgtataagataattttacagtaatatttttaaaacatatgctttttaaaaaatctcaaattgctgaaagttattaataatttgagaatctttacaaatatatgtacattaacaccattatgtttgcagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctcgttatttctgaaatacgttgtctgtaatagacccaggcaccttttaaattatctctggaacaagagggatttcatgtaatgaactaggaaatgcatactcacataagcaacaaggttctaggcagaaagccccttggaatttgtgaccaacaggagcaagaacaggtgcggctcaacatgcaatgtctgaaaatttgcttggcattttattcatatatttagtgcaaaattatttttgagtgagatattttacatcactgttaatgtgcaatatttaagattaaaatacattagcttttttatatactttgaagtagcaagtttgttttcgatggcttagagtcatgatttccagcttcccagcctttttatcagtcccttttctaatacaacaaggtgcattaatttgattaggcaaattagagttctaagacacttcttgaattgtagacagaaaatattggattcacaatttcagcagaaatttgagaatgagtgtgtttatattaatttcacaattagctgtattttctgtagcatagattatgtcactgttgcactttcacagcagacatgctttcagaaggttctcatattttatgtttgattgctgataagccatctctattgatacagattttggttaagtaaggaaaaccaggtgtgtgtctgtatcatttattgtaaatgccagctgccacttgccaaccatcatgttcagttcaattcaaagaaaacaaactctcattacttagtgtaaactaaaatac

SEQ ID NO: 437732 - DNA, 3865 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataaggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctgtaagttattttcttaatgtttacagaacatattgcattcttagagttagaatgacagttaggtttggaggagaccttttaattttaaataaaaatgtagatacatgatgatgatgtttttctgtttcttcatgaagactacgtcaaataaactaatgaacatattcgagcccctcctacacaaaataaagttacctcccactgttttttgcaatcttgcctggatacctaaccagagaactaggatgttgaatgctctgggggaacatcctaactcaggtataaaacaaattactgtatccaaaggaaaacagaattctgtgatctgtgatataaataaaatgtggcaatttcaagagctagaagaaaagaaaaaagacagttaaacattttatttcctgcaatgaaggagtcttcctaaactattatgtctgtataagtaagttgatgattgatcagtcttgatctaatgatatatttttataagtcatctgtgtggctaatatttcaaataactacagagttaaaatactcccagcatactgacttggttattattgccttgtgtttttcagccaccaccaaagatccctgacaagcagttagatgaaagggaacacacaatagaagagtggaaagaattgatatataaggaagttatggacttggaggagagaaccaagaatggagttatacgggggcagccctctcctttagcacaggtgcagcagtgatcaatggctctcagcatccatcatcatcgtcgtctgtcaatgatgtgtcttcaatgtcaacagatccgactttggcctctgatacagacagcagtctagaagcagcagctgggcctctgggctgctgtagatgactacttgggccatcggggggtgggagggatggggagtcggttagtcattgatagaactactttgaaaacaattcagtggtcttatttttgggtgatttttcaaaaaatgtagaattcattttgtagtaaagtagtttattttttttaatttcaagtgatgtaatttaaaacctaagttgtgtttcaaaacagcaacaaaactgtattgtattttttttgctgtaattaactgtataatgtaaacctaattattttatcatggtttaaattttttgcatatttgctttatcttatgctgctgatttttttaactgaatttgtaagattttgtttatcaaagcaactattatgtggtgacttgcctatatcatgaattatttaagatttttatagttttttttaattagaatttatttcagatgttttgttcatgatactatccttcagggttatgtgcttatcaatgaaataaccccagaggagtgagggaaaataacgtgtagccagttatattcaggaataactactgtaaatgatgaacgtgttaggagacctccaatatttgctacttgccaatcctaatttagttacaagaattggtaggcaatcctacttaattttggcaaaagccccgtcatctaaatggcagaataactcagagcatgtctttgaagatgctgggcgtctaccaccaccttatgtccccaccctacccaacaaaaataagtaaaaagaatatggtgtattctacaaatttgtggcatgctcaaagtttatgatcacataaaggcaagaggatacttcatgaataatacatttcaatgcaaataaacagatggttcacttctactagctatgagcctgtttttgtatacactgagttaatctactcaggctgtaggtcccagcaatgttctagagtctggtctttccctttcctgcagcttcgggtccttggacctttcctgtttcctattacttggagtgtctgtcagttgagcaccagttgttctggtgtttcatttgattctacttgtagcataatcatttatacgagctattgggaggttccaaaccctacctagatttgtgtaggtgatgtatcaaatgagcaatataccgttcatctgaaaatagtagcacacagccatatataggatatcattttctaaggactgtttcttcacattgagcagagcaggcataaatggtggttatttagtctaagtcttttatttttttatacctgattttcaacataacacgcaatgtggatgtcgagtagtgttaagaatggtgctgctcctgacaagtgtatgttaactgtttacattttctatctgtagaattatttctctattactgaacttttcctaagtaaaatgtctttgaagtctc

SEQ ID NO: 437733 - DNA, 1930 bp, Homo sapiens
cgcggtgacggcccgcgtctctgttactcagccgagcggccgaggccggacgacgcggcttggattgcggagccgcgagcagcgctgggtaacggccgcggcgaccaccccggacggcccctgtccccgctggcgggcttccctgtcgccgttcgctgcgctgccggtcttgcagccttacagtcatttgtaatggttacctcagattcccctgctgtggttaacgttaaacctaggaggtcagatgctctaagtgaacatgtttagtgctgtgcctgacaaaagcaagcaatcaaaatgggacttccttgagggcaggcctgtcttgcatctgtttctccaccacctagcctggaatataactggccttatgggtttctagaaggaaaatcacagaggtaaagcatcatttcatcacatcctgtcaaggcttcttggtgaatttttggatgaagccattaaattaattgcttgccatcatgagcagaagcaagcgtgacaacaatttttatagtgtagagattggagattctacattcacagtcctgaaacgatatcagaatttaaaacctataggctcaggagctcaaggaatagtatgcgcagcttatgatgccattcttgaaagaaatgttgcaatcaagaagctaagccgaccatttcagaatcagactcatgccaagcgggcctacagagagctagttcttatgaaatgtgttaatcacaaaaatataattggccttttgaatgttttcacaccacagaaatccctagaagaatttcaagatgtttacatagtcatggagctcatggatgcaaatctttgccaagtgattcagatggagctagatcatgaaagaatgtcctaccttctctatcagatgctgtgtggaatcaagcaccttcattctgctggaattattcatcgggacttaaagcccagtaatatagtagtaaaatctgattgcactttgaagattcttgacttcggtctggccaggactgcaggaacgagttttatgatgacgccttatgtagtgactcgctactacagagcacccgaggtcatccttggcatgggctacaaggaaaacggaggaagaatgggaaaaggcatattcacaaggttacaataaggtgcctgtgagatataaaatttataactgccacatcctttcttaggaatttttaaatttctattttcttgtaatatgaatacaagaatacattcttgtaaatgaatgtattgaacattagttatggagtatttttcttagctacttgatattagatattgatcagtggaataaagttattgaacagcttggaacaccatgtcctgaattcatgaagaaactgcaaccaacagtaaggacttacgttgaaaacagacctaaatatgctggatatagctttgagaaactcttccctgatgtccttttcccagctgactcagaacacaacaaacttaaagccagtcaggcaagggatttgttatccaaaatgctggtaatagatgcatctaaaaggatctctgtagatgaagctctccaacacccgtacatcaatgtctggtatgatccttctgaagcagaagctccaccaccaaagatccctgacaagcagttagatgaaagggaacacacaatagaagagtggaaaggtacattcgtcagattcttagagggaaaactgtgaaggagcttctggtttttatatggtgatttattatcatgttagagaaatttgtgactttaatatgcataaccgaaatgtggtaatattaatatttttacataagtagaaagtaagtctgcttccttccttaacttaatcttaagttcccaagtttcccaccccagacacagacacattagtgctctgtctcatatttttttccatggtttgtgaatacacaaatgtgtttagt

SEQ ID NO: 437734 - DNA, 3209 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagggaccgttcggggcgggccagaggccttggccaggagttcctcgcctgttagaaccaggatccaccccatcgcgggagccgcaccctgtggagcgttctggggtcccggccctgacctcttcctgggcttcgggatgcccgcgtcctctgcacccggcgctgcagctcgttatcgattccgcctttggaggccggtccgtatagtgtacctcccggactctctcacggttagccggcaacccgcggagccccctcccccatgcgatgagtccgccgtgaggggcggggcctcccattgtgccaatagaaacaatgactgaccgattggagtgctccgcgttcacccctcgcctccgctcctctcgtgacgtctgttgcgccaggtccacccattggcctggcgagaccggcgcgtgccaggagttacgcagggagagctggaatgcaccgagggtggggggaggactgagtttctgtgtcagtcccttcaaggggttaaggcatgcggtcgtgacggacgaggggcggggacccgaagaagcggggcccgcagccatggggcaacgccgggctccacgtggcatcccagagcactcgggactcgcagcctgggagggggtgcagcctccagtgaaggggccccgagcccgggagactgctggggaccagcaaggcagggaagaatttggcctctgctcccgcctcgggagggtcatctctggtccctgctccgcaggggcgatccaaacaagcaggtggtcgcgacatgtttcataaaactagctgatgggatagttaaagctattgttcggggtgctggcaccccagacccctctccagccatcgtcccctctaccccaggatttcacacagtaccccctcccagagctatgagaacgctcatgggcaccaaaatttcagaccaaaatccgggacacggttcagaactagtggtcaggaagggggaacaagagatctggaaggacagaaaaaggctgggagacggagctgggacagcgccctagaaggagggaggtgggtgaaggcggcgaccgaaagtggggagggcggacccaacgacggcgaaccttcgcgctctgttcagcaccaggagcaacgctcacgtcctcaataaagatggcggcaacac

SEQ ID NO: 437735 - DNA, 463 bp, Homo sapiens
ggcgtggtggttcacgcctgtaatcccagcactttgagagcccgaggtgggtggatcacttgaagtttggagtttgaaaccagcctggccaacatggcgaaaccccgtctctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437736 - DNA, 1074 bp, Homo sapiens
ccggcactcggtgaagacaggtggtgaggcctagacacaccgagagccgggccccgcggggcttccaagtgtcggatcagcaagatcatcctttcgaggtcgccgtccttgcaattagtagatgggacccactgccccagggcggtaggggcgcacccgctacgagcggagcgcgctttcaccgggagggcctggagcaggatgtcctccaggccattgaccgggccatcgaggctgtacacaacacagccatgcgggatggtggcaagtacagcctggaacagcgtggagtcctccagtgagtgttgaggggagtgaagtgggacctcccggaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggcaaaaaccatgccctcaggggtaatctgggtccacggctcctcagtcagcagcacctcctggaaagccttatacagctccagcccattcgacaagatccaggtgctcaaccacacccccttggtcccccgaccacacccaccgtttcacagcaatccctccactagtatcaccatgaccccgtgggccagggagatggcaacagtgatacaccgtctcctaggcacggaaacacggtgtcacgtcgccgcggcatccagcgccgccatagggcgctgcgtgacactcgactcgtcgtaactaagccccgacccacagcctcagaggaacgagcaacacctagcgtgtcctgagtgcgccagctacgtagcagacagcacgagacaacggcccgcaccgcacgcgatggcgtactcaggcgc

SEQ ID NO: 437737 - DNA, 789 bp, Homo sapiens
ggatttaccgttctgcaacaacggactggtacatacatggaacaggatgatggcactgagaaagccaatgaccgaatctcttttctctgtaaaaatgtagactgaaaagccatgtgtattttcctatgtgctgtagctctcctttggaaataaatcacaggcatctggaaaaaaaaaaaaaaaaaaaaaaaaaaaaaaaaaaaaaaaaaaaaaaaaaaaaaaaaaaaaaaaaagacgagggagcagccgagaaaaatagtgttccaagaagaaaggagacaaagatagataaagagacaaaccagcaagatatgttttgtaggaaaaaaggggcgcacccaaaataggagagctactaatataaaacgccaacgcacaccggcgcgcgcgtgtaataacacgccgtgtgtagtcgaaacaaaagcggccaatggtgaccttcttgggagacagcccccaccatctgtggcggggagacacagatgggagaacaaccatccaactgagagaagatgatttaagagcgctcgcggaagggagaaaacattaaaaataataatggaggggggatatagtggttggagtacaaccacacggacgagtattattgtagaggagctgggtaaaaaatttgtctaactacgagatatattaatgattggaagaaaatttattataaccagcggagtgttgctagtaaaaaacgagataaattaagtattgatgtacaatatgagaagtacaaacaagttaatatcagtaggtagaaatatgacaaagggggacacg

SEQ ID NO: 437738 - DNA, 2942 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437739 - DNA, 3352 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaaaaaaaaaaaaaaaaaaaaaaaaaaaaaaaaaaaaccccggggacaaaattaagacggggggccggaacaaaagggctaataaaaaggggcccatgggtcccaaagcggtgtttcccggaccccatttttttgtcacacggggggaaaacccggcgccgggcccccccataatggaggagcagccacaaaaaactcccaaagaagcccgggtaacccgccgcaataaaaaaaccgcgccaatcaagcacgcagagaagaacaaagcgagcacgagcagaaagaggaagataatagacaaacaaaacggaagtaacctatgaacaaccactaaatgagcccgaataacaaaggaagccgccagcaaacaaagcacacagacaacagcgaagttagtaggagcaacaaagacc

SEQ ID NO: 437740 - DNA, 2861 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437741 - DNA, 3027 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccaggtggggtggggcctggctgggcggtggctgagcacatggtggctctcaggctcagcaccctgtctatacccatgtccttccttagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437742 - DNA, 2659 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccatcccacctctggttgatcctggctcagagcctggcctgggtgacgagttccccagtcattttgcttattgggtggtctttctcctcccg

SEQ ID NO: 437743 - DNA, 364 bp, Homo sapiens
cgaaaggatgcgccgactgattggttgatggtgatgtcatagggaccgttcggggcgggccagaggccttggccaggagttcctcgcctgttagaaccaggatccaccccatcgcgggagccgcaccctgtggagcgttctggggtcccggccctgacctcttcctgggcttcgggatgcccgcgtcctctgcacccggcgctgcagctcgttatcgattccgcctttggaggccggtccgtatagtgtacctcccggactctctcacggttagccggcaacccgcggagccccctcccccatgcgatgagtccgccgtgaggggcggggcctcccattgtgccaatagaaacaatgactgacc

SEQ ID NO: 437744 - DNA, 2963 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437745 - DNA, 1355 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggtgagggtgggcggcacagcagggccaccctgctacccaccctgttcccaccgtcacacacttgtccagcctgtacattacaggtatttctcaagctctggctctgagctcttactgtgctgggcactggggacgttgagctgatttctgaagcagaaaggaaggacaa

SEQ ID NO: 437746 - DNA, 790 bp, Homo sapiens
ggcgggacaaccgcggcgcggctcggcgctccgggcctggcgttgtggcgccgcagcccttgccaccttccctgcacctgccctgcccggcctcatgtaccgcgcgctgtacgcgttccgctcggcggagcccaacgcgctggcgttcgccgcgggcgagaccttcctggtgctagagcgaagcagcgcgcactggtggctggccgcgcgggcgcgcagtggtgagacgggctacgtgccgccagcctacctgcgccgcctgcaggtctaactgctgtcccctgccccccccagggcctggagcaggatgtcctccaggccattgaccgggccatcgaggctgtacacaacacagccatgcgggatggtggcaagtacagcctggaacagcgtggagtcctccagaagctgatccaccaccggaaagagaccctgtcacgcagaggcccttcagcctccagtgttgcagttatgacctcatcaaccagtgaccaccacttggatgctgctgcagccaggcagcccaatggggtgtgtcgagctgggttcgagcggcagcacagcctacccagttctgagcatcttggggcagatggaggcctctaccagatcccacttccatcttcccagatcccaccacagcctcgccgagcagcacccaccacaccgcccccaccagtgaagcgccgagaccgcgaggccctgatggcctctgggagtggtggcacaaaaccattgcctccgggggtaactctgtgtacaagcgagtcctcagttcagaggcaactcc

SEQ ID NO: 437747 - DNA, 2828 bp, Homo sapiens
agcggagggcgcggggagcagcaggcagagcagcggcccgaggcggccggggacaggcccgcgggctccatgggccgcggctacgccgcccgcgagggctggaaggcactagaagcgccgccggggctgcccagaggccgggtccccgctccactttgcgcaaacttgtttttctgaggtcagcgctgcgagctggctacatcgtcctcttaaggtggcctggggaagttgcggccgacctcccctcgcctccggactccggccgcgcggctactcccgcttcccactggcgagaggctggaggcggcgaaggagtcggggagtggaggcgcgggggtgggggggtgtctgccttttaaccctccccaagaggtcgtgcctctgagccccaaagctgaaggcccctcttgggggtgggtgcgggccggaggggaccgatcctttcagagccgtgccatcttcccagatcccaccacagcctcgccgagcagcacccaccacaccgcccccaccagtgaagcgccgagaccgcgaggccctgatggcctctgggagtggtggccacaacaccatgccctccgggggtaactctgtgtccagcggctcctcagtcagcagcacctccctggacacgctctataccagctccagcccatctgaaccaggctccagctgctcacccacacccccacctgtgccccgccgaggcacccacaccaccgtgtcccaagtccagccccctccctccaaggcatcagcacctgaaccccctgcagaagaagaagtggcaactggtacaacctcagcctctgatgacctggaagccctgggtacactgagcctggggaccacagaggagaaggcagcagctgaggcggctgtgcccaggaccattggggccgagctgatggagctggtgcggagaaacactggcctgagccacgaattatgccgggtggccatcggcatcatagtgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437748 - DNA, 1877 bp, Homo sapiens
tctagccaccaagcatactctcctgggtcacatccaggcctcggtgccggccagctcaccagtcatggagcaggtcctcctctcactcgtagagggcaaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437749 - DNA, 2098 bp, Homo sapiens
cattttgtgtggaatgggagagtgaggtctcagagtcacattctggcagtgacagagttcatggccctcctagttgggggtgtttatccaggtctgggatgagaggcgagctgttgaaaaccccctacagatgagtctcccgttgactcctgtcctgggaggtcatcaagactggagttgagcctcctgtccagtgtgggccaggagggacttgagttcatggagtaaaagtccacagatggactctccaggccttggaggctccctggagatggtgagggcagggagtgtgctgagtcatgccttgccctctccctctaggacctcagcatggccctgccctcagggcaggtctgccacgaccagcagaggctggaggtgatctttgcagacctggctcgccggaaggacgacgcccagcagcgcagttgggcactatatgaggatgagggtgtcatccgctgctacctagaggagctgctgcatattctgactgatgcagaccctgaagtttgcaagaaaatgtgcaagagaaacgagttcgagtctgtcctggccttggtggcctattaccaaatggaacaccgagcatcactgcggctgctgctcctcaagtgctttggcgccatgtgcagcctggatgcagccatcatctccacgcttgtgtcatccgtgctgcctgtagagctggcgagggacatgcagacagacacgcaggaccaccagaaactctgttactctgccctcatcctggccatggtcttctccatgggagaggcagtgccctatgcacactatgagcacctgggcacgcctttcgcccagttcctactgaacatcgtcgaggatgggctgcccttggacaccacagagcagctgccggacctctgcgtgaacctgcttctggctctcaacctgcacctgccagctgctgaccagaatgtcatcatggctgccctgagcaaacacgccaatgtcaagatcttctccgagaagctgttgttgctcctgaacagaggggatgaccctgtgcgcatcttcaaacatgagccacagccaccacactctgtcctcaagttcctgcaggacgtgtttggcagcccggccacagctgccatcttctaccacacagacatgatggctctcattgacatcactgtgcggcacatcgcagacctgtcaccaggagacaagctgcgcatggagtacctctccctgatgcatgctatagtccgcaccacaccctacctgcagcaccgccaccggctacccgacctgcaggccatactgcgacgcatcctgaatgaggaggagacctcaccccagtgccagatggaccgcatgattgtccgagagatgtgcaaggaattcctggtgctgggggaggctcccagctagcaccttgctgtcctcccttccctgcagctccagtcagtgtgcaggggactcaggggcttggccctaagaatgttttgcactgacagtgggaggggataaggtggcagaaggaacctgagcaggacccccacctgaagtagaacttaagagaggggccaagtgtaggattggggaccatggtctgggagctgttctggggcagggggaatatgcaagctaaagcccctctataccctggtaggcttcctcttcagcatgcccccctcttcaccccacacccatgtgtacactcagagtcctgctgccgctccaggctggaccagacccccatccccacccctcctggtctgtatcctgggcctcagcaagccatgcccctggggtgaggggaggcatctcccaccagctctattctttgccttagctttgcagtgagtgctgctcatgtcctcccctccacccgcacatgggggtcgctgcccttcactcctacccccagaggccttggccaagctgctgctttgaaagcgggatcttggagacaggccatccatcctggagcctcatggaacaggatgatggcactgagaaagccaatgaccgaatctcttttctctgtaaaaatgtagactgaaaagccatgtgtattttcctatgtgctgtagctctcctttggaaataaatcacaggcatctggaaa

SEQ ID NO: 437750 - DNA, 986 bp, Homo sapiens
  misc_feature (9)..(9): n is a, c, g, or t
aaaacatanggcatggtacgaggctgggtggtgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgaaaagtctctgggaaataataataatccgggtgaaaaaaaaaccggctttggcgaaggtagcggagtcccctttagggaggctggt

SEQ ID NO: 437751 - DNA, 173 bp, Homo sapiens
gacagagacctggcaccctcctgggacagtgggctgtctagctcggactccaagaagagaggcagggaagggcagagctttaaaagtcaccccggaggctgaggcaggaggatcacctgaggtcaggagttcaagaccagcctggccaacatggtgaaatcccatctctacta

SEQ ID NO: 437752 - DNA, 1561 bp, Homo sapiens
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437753 - DNA, 1875 bp, Homo sapiens
caatttgagtttccatttctcggatttgggaactggtataagcattgtctgtgatgtaaacaaagtcttcaatatttggagaaaacatctcctcatacttgagagcacaagaggaagagagagaccctcactgctggggagtccctgccacactcagtcccccaccacactgaatcggaattccgagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgcatgtttgcttctgggacgtctgtgccccgcaagtgtttgagtttggcctccaccccattgatgcggtgacggggcggaaaggcgcagagaagctgagggcggtctctgatctgtgtgtgggttgacattttagctaataaagccttgcagtgtttgttggca

SEQ ID NO: 437754 - DNA, 1358 bp, Homo sapiens
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaaagtgctagaattacaggtgtgagccactgcgcctgggctacctttttaatggtttttaagagacagggtcttgctctgt

SEQ ID NO: 437755 - DNA, 1254 bp, Homo sapiens
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccagagtctccatctggggaaaaaaattaaataaataaactcccgtgacttgca

SEQ ID NO: 437756 - DNA, 1459 bp, Homo sapiens
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437757 - DNA, 1456 bp, Homo sapiens
caccccaaaaaataggctaggtacgaggctgggtgttgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437758 - DNA, 1665 bp, Homo sapiens
caccccaaaaaataggctaggtacgaggctgggtgttgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcggggtcagaggtgacggagatgcaaacagcagtgaacataactcaagagctacctgaggtccttctggtggtttgaagtctttactggagatctcattcccagggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437759 - DNA, 954 bp, Homo sapiens
  misc_feature (9)..(9): n is a, c, g, or t
aaaacatanggcatggtacgaggctgggtggtgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437760 - DNA, 514 bp, Homo sapiens
caccccaaaaaataggctaggtacgaggctgggtgttgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacaggtagagtgctttgccaaatgtatt

SEQ ID NO: 437761 - DNA, 437 bp, Homo sapiens
ggcgtgagccctcgtgtccggcctaccaagtctctattgagtgcctggggctgtgtggattgtgcagctgcagccttatgaccaaagagctagcaggatgatgccggcctctgcagggaagcctcactactgtcccgtctctgttcagagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggtatgtgggctgctaccattcaggcgtgggcatcctgtgcctgccatgccccttccatggggaaggggagggaagtgacagctgcacaaggtacaacaagagaaagagacagagacctggcaccctcctgg

SEQ ID NO: 437762 - DNA, 355 bp, Homo sapiens
attgtgccactacactccatgctgggtgacagagtgagactctgtctcaaaaaaaaaaaaaaaaaaaaaaagtcacccttggcccggtgcggtggctcatgcctgtaatcccagcacttgggaggcggaggtgggagaatcgcttaagcccaggagttcgagaccagcctgggcaacatagcgagactcctgtctctactcaaaaagaaataaatataaaaatcatccttgacatgtgtttgctcctgaacaggcgctgaacaacctgcagtccaccttctcaggatttggcttcattaacagtgagaacgtgttcaaggtacaagcgctagtgtgggtggtactgtcagcagaa

SEQ ID NO: 437763 - DNA, 1714 bp, Homo sapiens
caatttgagtttccatttctcggatttgggaactggtataagcattgtctgtgatgtaaacaaagtcttcaatatttggagaaaacatctcctcatacttgagagcacaagaggaagagagagaccctcactgctggggagtccctgccacactcagtcccccaccacactgaatcggaattccgagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437764 - DNA, 1581 bp, Homo sapiens
cacccccccccccccccccccaacatacgtctggtaggctggtgtgttatcggccgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437765 - DNA, 1746 bp, Homo sapiens
caatttgagtttccatttctcggatttgggaactggtataagcattgtctgtgatgtaaacaaagtcttcaatatttggagaaaacatctcctcatacttgagagcacaagaggaagagagagaccctcactgctggggagtccctgccacactcagtcccccaccacactgaatcggaattccgagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgaaaagtctctgggaaataataataatccgggtgaaaaaaaaaccggctttggcgaaggtagcggagtcccctttagggaggctggt

SEQ ID NO: 437766 - DNA, 1461 bp, Homo sapiens
caccccaaaaaataggctaggtacgaggctgggtgttgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437767 - DNA, 1635 bp, Homo sapiens
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagggttggcctccttccccccgtcctggcagaggaaccgctcacttcttgggcagaggagagcgggagcccttctgattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437768 - DNA, 1612 bp, Homo sapiens
caccccaaaaaataggctaggtacgaggctgggtgttgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagagtcatccagaagcaagttttaaccggttttaatgatcattttcgccgtaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaacctgcagtccaccttctcaggatttggcttcattaacagtgagaacgtgttcaaggtctgtgacgagccccacccactgctggtaaaggagatgatccagcactgtgtgaatgccaacattgacgaagcctacaagattcttgctcacttgtggcatctgggctactcaccagaagatatcattggcaacatctttcgagtgtgtaaaactttccaaatggcagaatacctgaaactggagtttatcaaggaaattggatacactcacatgaaaatagcggaaggagtgaactctcttttgcagatggcaggcctcctggcaaggctgtgtcagaagacaatggccccggtggccagttagagcagagacttcactgactgacttacaggtgccctattctgaggtacaggagccgcggctttctgatgggggaaaatgccgccttaggctggagccaacatgactgtcctttaaactccagtggctggccaggcacggtagctcacgcctgtaatcccaacactttgggaggccgaggcaggtggatcacctgaggtcagaagttcaagaccagcctggccaacatggggaaaccctgtctttactaaaaatataaaaattagctgggtgtggtggcgggcacctgtaatcccagctactcgggaggctgtggcaggagaatcgcttgaacccaggaggtggaggttgcagtgagccaagatcacaccattgcactccagcctgggcgacagagtctccatctggggaaaaaaattaaataaataaactcccgtgacttgca

SEQ ID NO: 437769 - DNA, 991 bp, Homo sapiens
  misc_feature (794)..(794): n is a, c, g, or t
  misc_feature (810)..(810): n is a, c, g, or t
  misc_feature (818)..(818): n is a, c, g, or t
  misc_feature (820)..(820): n is a, c, g, or t
ggcgtcaaggggcggtgcctcgggtggcgggaagagggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaattgtcgggaatgaagacaccgtgagcaggctagaggtctttgcaagggaaggaaatgtgcccaacatcatcattgcgggccctccaggaaccggcaagaccacaagcattctgtgcttggcccgggccctgctgggcccagcactcaaagatgccatgttggaactcaatgcttcaaatgacaggggcattgacgttgtgaggaataaaattaaaatgtttgctcaacaaaaagtcactcttcccaaaggccgacataagatcatcattctggatgaagcagacagcatgaccgacggagcccagcaagccttgaggagaaccatggaaatctactctaaaaccactcgcttcgcccttgcttgtaatgcttcggataagatcatcgagcccattcagtcccgctgtgcagtcctccggtacacaaagctgaccgacgcccagatcctcaccaggctgatgaatgttatcgagaaggagagggtaccctacactgatgacggcctagaagccatcatcttcacggcccagggagacatgaggcaggcgctgaacaactgggtcacttctcaggattggttcttaccagtggnacgtgtcaagtcgtgngagcccancntgtggtagggtggtcccctggtgtgcgctgggggcctcaggttggtcttggggtggtccccgaatcttggcctcggggatcaagggacccgggtcgggtcccaaggggctcggggcgggggaaaccggggcttcgtcttccggtctccttcttccgccgggcgtgctcccc

SEQ ID NO: 437770 - DNA, 2386 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagcc

SEQ ID NO: 437771 - DNA, 2138 bp, Homo sapiens
caagagcaggcctggagacccgggagtgccttggggagagggtccccgccctgccgggagcccggccctcccggtgccggggtggacactgttagtgtagtcattgtccctatggagaaactgaggcatggagaggctgaagtcacacaagcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagcc

SEQ ID NO: 437772 - DNA, 2507 bp, Homo sapiens
cttagaagggaggtatctgaccctctgctcagggcccactgcaggtcagtgcccgtgtggtcacagggtcccatcccttccctggctctggcttggcctcagctcagatgcctcacgccgggacttcccgttctctgctgggctttgtgtgcagggcattccccgggccagtgcaaaggccactaatgccagaagggtcagaccacctccctcgtgatgaaccagcagaacatgtggccgggttgctccttaatctgtcgtaagtcagaagttaatcagagggcaaagaagacctttcatccactcagctgctgctatttgcttattcactaactgctgcctgtcctgtctgtgggaactttccaccgtctggatgctgtctgtcatacaggcgcttggagctgctgagctttcctgaaaagggggacccttccttaaaactctaggaactagagtggcattgtgatggaaatactcttatgctcattgaaactgtccctctgaacttctccctcgaaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagcc

SEQ ID NO: 437773 - DNA, 4307 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgttcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437774 - DNA, 4849 bp, Homo sapiens
cttagaagggaggtatctgaccctctgctcagggcccactgcaggtcagtgcccgtgtggtcacagggtcccatcccttccctggctctggcttggcctcagctcagatgcctcacgccgggacttcccgttctctgctgggctttgtgtgcagggcattccccgggccagtgcaaaggccactaatgccagaagggtcagaccacctccctcgtgatgaaccagcagaacatgtggccgggttgctccttaatctgtcgtaagtcagaagttaatcagagggcaaagaagacctttcatccactcagctgctgctatttgcttattcactaactgctgcctgtcctgtctgtgggaactttccaccgtctggatgctgtctgtcatacaggcgcttggagctgctgagctttcctgaaaagggggacccttccttaaaactctaggaactagagtggcattgtgatggaaatactcttatgctcattgaaactgtccctctgaacttctccctcgaaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttggatccagtctaagacaccgcattgcattgaatcgcctgctttcttagtctcctctggcctttaacactttctcagacttgccttgttcacagccttgatagttttgaggagtactgggcagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437775 - DNA, 4807 bp, Homo sapiens
tctcggctcactgcaacctctacttcccgggttcaagtgattctcctgcctcagcttccaagtatctgggattacaggcatgtgcccccaagcccagctaatttttgtatttttagtagagatggtgtttcacctgaggtcaggagttcaagaccagcctgccaacatggtgaaaccctgtttctacaaaaatacaaaaattagccaggtgtggtggtgtgcgcctgtaatcccagctacttgggaggctgaggtgggagaatcgcttgaacctgggaggcagaggttgcagcgagccaagatcatgccattgcactccagcctgggcaacagagcaagactccgtctcaaaaaaaaaaaaaaaaaaagaaaagaaaaagaaaatgcttttgtttctcagccttctccttggtgattagagagggatttttacagtaagcccagaaacctccgtcagctcatgaagaagaaagtgggcccagcactgaggtgggagatggggcaggcaggcttcattttgcatccttaaatgtggagcccagggaatgcatgtggggtgtcaattatctgagccaaatggacagaagactgataaacctttgccctccacactggctggcggagcaggcgtggcaccggttgagcccgctgcagcccgctcatgaatgtgcctgctcatggtgatggtggtgtgcactcagtgggaacttaagtaaggccatcgcttatgaataagacccactaattgaacgattccatgttttctagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437776 - DNA, 4552 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437777 - DNA, 2172 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcagcccactattagccaactcatatgagtagcatagataaatacgcatatgataattgcatgtctgctacttataagtaatctcagagtactgatc

SEQ ID NO: 437778 - DNA, 1637 bp, Homo sapiens
cttagaagggaggtatctgaccctctgctcagggcccactgcaggtcagtgcccgtgtggtcacagggtcccatcccttccctggctctggcttggcctcagctcagatgcctcacgccgggacttcccgttctctgctgggctttgtgtgcagggcattccccgggccagtgcaaaggccactaatgccagaagggtcagaccacctccctcgtgatgaaccagcagaacatgtggccgggttgctccttaatctgtcgtaagtcagaagttaatcagagggcaaagaagacctttcatccactcagctgctgctatttgcttattcactaactgctgcctgtcctgtctgtgggaactttccaccgtctggatgctgtctgtcatacaggcgcttggagctgctgagctttcctgaaaagggggacccttccttaaaactctaggaactagagtggcattgtgatggaaatactcttatgctcattgaaactgtccctctgaacttctccctcgaaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttggatccagtctaagacaccgcattgcattgaatcgcctgctttcttagtctcctctggcctttaacactttctcagacttgccttgttcacagccttgatagttttgaggagtactgggcaggtatttcgtagaacatctctcagtttgaatttgccagttgtgtttaggatgggactggagttaggagtctttgggaggcatgcctgggaggtgacatgcccctctcccttgtcttgcattaattctgggggtgtgtgatattcacatgacgtcagtgatattcaccttgaacacttggttaagggcatgtttgctgggtttttccactgcaaagtttctgtttccctttccatactctgtctgttgaaagtgagtcactaagtctagtgggcttcatctttaaatatctgattggtgatatttaaaaatcgtgagatgttttaaagctacaaatctggtattttgtgtggtagcaatgaactggcgtgaagtagccactgccactccataggaaccaagctgtccagctcttctgtgtcctgggcctcggaaggtccatgcgattcaaggcttggttggcccagactatagactgggatgaagtcagagcctgccacccatccaatctcagcaggggagaggccgggtaaggcccaaccgccccttcactcttcttagttcctccctggctcttggaggcacttgactttggaccccttccctagggcaccttccgcttctctgcaccatattctgcacgtggcctcttcaggtagaactttccgtggatacaaggtctttaagtcccagaatagcatgacatagccttggcaatgagtttacatttaacaataatgtttctgcccttttagggtggcagaagtagaaatagtaagctaccttacatttgatatttatttttatttttttgagatggagtctcactc

SEQ ID NO: 437779 - DNA, 2216 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagcc

SEQ ID NO: 437780 - DNA, 4607 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437781 - DNA, 4553 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaatcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437782 - DNA, 4728 bp, Homo sapiens
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttggatccagtctaagacaccgcattgcattgaatcgcctgctttcttagtctcctctggcctttaacactttctcagacttgccttgttcacagccttgatagttttgaggagtactgggcagggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437783 - DNA, 4040 bp, Homo sapiens
aaaatctgttcgcttcattcattgccccctcccccgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaaccttcaatttaaaaaaaaaacacagtattcacaaagcatagtagaatgaggtatgcctgtattgctctttctgaagtggtgtgatataaaccatctctaagaaatgtttctaccctaaagatttccccagtacagtcagctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacaggaaggtgtgcgtaggttacgtgcaaacgctatgccattgcccatcagggacttgagcatcctcagatgtcggtgtctgagggttgaggttgcagtcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437784 - DNA, 4623 bp, Homo sapiens
  misc_feature (1847)..(1851): n is a, c, g, or t
  misc_feature (1869)..(1869): n is a, c, g, or t
  misc_feature (1901)..(1901): n is a, c, g, or t
  misc_feature (1929)..(1929): n is a, c, g, or t
  misc_feature (1950)..(1950): n is a, c, g, or t
  misc_feature (1953)..(1953): n is a, c, g, or t
  misc_feature (1964)..(1964): n is a, c, g, or t
  misc_feature (1968)..(1968): n is a, c, g, or t
  misc_feature (2204)..(2204): n is a, c, g, or t
  misc_feature (2209)..(2209): n is a, c, g, or t
  misc_feature (2214)..(2214): n is a, c, g, or t
  misc_feature (2218)..(2218): n is a, c, g, or t
  misc_feature (2220)..(2220): n is a, c, g, or t
  misc_feature (2225)..(2225): n is a, c, g, or t
  misc_feature (2231)..(2232): n is a, c, g, or t
  misc_feature (2237)..(2237): n is a, c, g, or t
  misc_feature (2242)..(2242): n is a, c, g, or t
  misc_feature (2247)..(2247): n is a, c, g, or t
  misc_feature (2250)..(2250): n is a, c, g, or t
  misc_feature (2256)..(2256): n is a, c, g, or t
  misc_feature (2272)..(2273): n is a, c, g, or t
aaaggcagggctgggcctgcgggagcgcggccttgcggttcccaggactcttctccgggcgcctcgtctccttacgccacccgcaacccaagccagggccccggtgacagcggcggggtgggccaggaccggggagggggtgcccagcagcgacccccggctccccctaaggccgggcgcagctcggagccaggagctggcccggcgcgtggcttcccggaaggcccggcgcagccggaaggtgggacggagggcggggccagcgccggggccgccaccaaggcctgcgcgaccctccgcggggctggggagctgggcggggagcccggggcctgccaggcccgggctgcagccgcgtctgatcgccgagcgcgccgcgtagacctccgctcccccaggcccgccacgatgactatcatggtggaggacatcatgaagctgctgtgctccctttctggggagaggaagatgaaggcggctgtcaagcactctgggaagggtgccctggtcacaggggccatggccttcgtcgggggtttggtgggcggcccaccgggactcgccgttgggggggctgtcggggggctgttaggtgcctggatgacaagtggacagtttaagccggttcctcagatcctaatggagctgccccctgccgagcaacagaggctctttaacgaagccgcagccatcatcaggcacctggagtggacggacgccgtgcagctgaccgcgctggtcatgggcagcgaggccctgcagcagcagctgctggccatgctggtgaactacgtcaccaaggagctgcgggccgagatccagtatgatgactaggccgcacctccggggaggtggggggcccctttaaatgactctgtgattctgaagaggtggcttgggagttgggagaagcccagcggatgccccctggggaatctccacatcatcagtgtattactagtaatgtcccgctggagaggccaccgctgtgcagtgtcatgttccagaaattactgatgaagcagcatgtgttggtggcatgtgcactggcctgccatgacagccctctgactggccccccagtgaagagtaaaggcctgcctgccgcaggcttcggaggcgtctgctgagtcctctcacccgcatgggtctggggaagtgatcacgctcagccgacggtctgaccacacttcatcctccccccggggccttctcatcttgggagatgactcctcttcagagcacctgctgcaggactggatcccacccccctgcaggtcctggggtctcagggccttggagcagcccatgctggaatcatgtttacctcctagtgcaaccgtcccctacccagggactgtcgaatggccccacggaggggacgggcggcctgctgagtgaagccacaaataccgagtggacttgaccccggcccccactaggctgcacacctagactcgccctgccagggcctcgctcttcccatctgaaaagtcctggtagttcttgaggtttacttctcaaatgaaatatttttagtaaaaagtacaggtatatctcggagatattgtgggttcagttccagaccacctcggtaaagccaacatcacaataaagcaaggaagcgcattgttttagtttcccagtgcatctaagtcatgtttactgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagacttgcctgatgccaggctgctacaaacctttttttttaannnnnttcttctttattcacaanttattttttattttttttttcctttttttctnttttttatattttttttttatatttatnttattttttttaaatattttnttnttttatataantttncttctattttctatctcttctctccgtaactgtggtctccacatttagatccaaccagccttggataggaaatatttgaaaaaagaaattgcattggtactgaacacgtacagacctttttttcttgccattattccctaaacaatatggtgtagcatatttacatagcatttatattgtatttggtattataagaaatctagagatgatttaaattatacattaattttttcttnttttnctttnaaantntattntatttnntcttnatttnttttntcntcttcntatttcttttttttannttttatttttcattcctggaacccatcccccatggatactgaggcatagctgtactgtgtgttttcactttgctttcagaactacgacttgaatgtgatcgattacaataaatgtttttctaaaaagccattttcccacatattatgtgtaaaatatctctaatattcaaagtcttacaaatggaacaagagggaaggtaccagatttgtggctttaaagaatgcaagagtaggtcaggtgaggtggctcatgcttgtaatgtcggcacttttggaggccaaagtgggaggatcgcttgaggccaagagtttgaaactagcctgggcaatatagtgagacctccatctctacaaaaaatgttattccttggtccccaggtcctggggcagggcagggacttggggctctcctctcaggccctggaggctcggagggaggcacttctgctgaggccctgcttataggaaagctcagtatcctggcacctccatgtgtgtaaggacgtcagggtgaattataacccatggtgattaaggaagggccgagcctttctcttgcagagcgattgctcttctgctggcctcgtctagcacaaatcaggtgccctagcacaggccacactcctggagttaatgaagccactttaatcatttatatgccacttaagttgatgggggacagggcaggggtgggaaggaggggttgtctgtctgtgaaaactgagtgtggcttttcttgttgaactgatcattcctgctcttcctgcaaataagtcctgcatacggaccctggaactaaaaatggaaaatcagagcatgccccctcccaattttgtatagctttagtgggctctaaagttgcccgtttttagtgtgaaggaaaaaacgttgatttgcagatatcgtgagaatgaaacctcaacaaagatgtttggttcagtgcttcaaagttgggggacactttttccatgttgaacaaatgccaacttctccggttgcttacagcaaatccttctggaacaatcggggctgaaattgagttgcctttgttaggcgattgggccccattcattcttactcgtgcatcaggtcctggtctgtgtcaggcccaggggacacaggtggtcccagctcagaggcccagtgtccactgcagcccctcccacagcctgcccacccctactgcagggaaaaatgcccagggaggagatggtccaactcctgatcagttttgtgtccgatggagcaggccttgctgagtgaagacactggaactagctgggtcctggggtgacttggaggctttgggcctaaaagggcagcctgaacctggagtcttatctcccccaggagccgaaagcactttttcttgatttcccccaggaaatcaagcgctgcttctcagctcctgtggttttagtatttatatatctgtatcttctttgtagaaatttatttatttttgaataagtaatacctgcctggtacaaaatttaaaaggtacgggagggcgcaagctgcaagggaaggcctgctcccatgccgaccccagaggcagccactgttaccaatttcatgtgtattcctttaactctgttttaaagtaagtctctgaaaactgttcatttccttttgtcagtatttgttgctgaaaacctagaaaaacccagaaaagtataatgaaataaaaactacaaatttcacaacccagaaaactgctggtaacagatttggtgtctttcctgcaattgttttaatgctatgtaggtacacatatatttttttctttttttcttttttttttgagatggagtctcgcactgtcgcccgggctggagtgcagtagcgcgatcttggttcactgcaagctctgcctcctgggttcaagccattctcctgcctcagcctcccgagtagctttgactacagtcgcccgccaccatgcccggctaatttttatttttttattttttttttatttttagtagagacggggtttcaccatgttggccaggatggtctcaatctccttacctcgtgatctgcccacctcagcctcccagagtgctgggattacaggcgtgagccactgcgcccggcctatgtatgtatatttctaacgtacttgccttcttatcctatatgcccctttgaacacctgtatcaatgaatgttaaataatatttttgatgtaatttaaaattccttgtaaatatttgtaatggctgcataatattccactgtgcctaaccatgtgcctggtgtgaattccatttgtggatttttactactgtaatgctgaagtattacagtaatactgtgttaatattctctttattgaattctggta

SEQ ID NO: 437785 - DNA, 1830 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaa

SEQ ID NO: 437786 - DNA, 1951 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggtaacttcatgagaatctaccgtctttcacctttggcagtcaggacttctcttgtgatctcatctctgcatgtgactacttcaccagcatgatcatgaatgaatttgtctcctttagacaagggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaa

SEQ ID NO: 437787 - DNA, 2252 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaaaaaaaaaaaaaaacaaaaaaaaaaaaaaaaaaaaaaaaaaaaaaaaaggggggggggaaaaaaacccacggagagggggaccccgaacataggcaaccaccacttttgtgaacggggggcccccgaaggagactgtctattaaacggccgcgacgggcgctataaacaggcagcgggcggcaacaggccagctggtaacgagggagacacccttcgcgggggagccatgggagacccaccacccatctaggccgggaaacaaaatcagctatgggaagcccccatcggtcggaaatgctcggttatttgataccgacgaaagacaaccggacgacgcagcacctgacccacgagacaccgatccagcaaatgaaacaccccacgcacgacacttcgacttagtaggacgaggctgggcgtgg

SEQ ID NO: 437788 - DNA, 1783 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatata

SEQ ID NO: 437789 - DNA, 1713 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaa

SEQ ID NO: 437790 - DNA, 2095 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggtaacttcatgagaatctaccgtctttcacctttggcagtcaggacttctcttgtgatctcatctctgcatgtgactacttcaccagcatgatcatgaatgaatttgtctcctttagacaagtatgtttctgttttgactgtcactgccaggtggtgaggaagcaaagagttaagaaataaacaggcaggtctgaggaaagtgatttagaaaaatattttgatttatttaaactttaaactacagagtagaaggaagaaaaaagcaccacttggggtcccactctctaaataccacctgttttaaatgttgtgatatatttctctttatcttttgcctgtatatgaacttgaaaaaatattatttaaaatttgaggaattataaagtttttgctttaaaaacaacagaagctggaaatagaaaaatgggaggagagtattcattttgcaaaagaatttcctcagatttgttttttaatgttgctttattgtttttggaaatctgtgacactcttcgtaaaaagattaaaactgtatagaaaacttcgaagaggaaagtaaagaacttgaaattccactatgtaaagaatgcatgcccctgttagtcacgttgtggtgaacattgtccagcatccagccatgcagatccttcatgtaactgcatgtccctgtgacgcggagacactttcctgctcagtgacctgctcttgagttaacccacctgtgctcagaaccggctctgtcctccgctggcttgtgggctctctgtgcctgggggttctctgtaaaatgaggtaatagttgtatctatctcatgggattagtaggtggattaaaccagttaatacaggtaagtacttaatgaatg

SEQ ID NO: 437791 - DNA, 1535 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacagatcttggctcactgcaacctctgccacctgggttcaagctattctcctgcctcagcctcccgagtagctgggattacaggctcctgccaccactcctggctaatttttgtatttttagtggagatggggttttgccatgttgggcaggctggtctcgaactcctgacctcacatgatccactcgccttggcctcccaaagtgattacaggcgtgagccaccacgcccagcggaatttcttattctttttgatctatcaaaacacctcaattgttctcaatgactgaccaaagcttgggaacctctga

SEQ ID NO: 437792 - DNA, 1518 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaa

SEQ ID NO: 437793 - DNA, 1096 bp, Homo sapiens
tctaccacaacaaaccaaatttataagacaacccctcacaatcatttaggaatgccacagtaagggaatggaaatacactaaaataatttttgttcccttctctctctaatttagtcagtcataataacaaagcagcttcatgttaaggacttaattctgattccattgcttggtctgtcaattttatttatcatatcaatctacctcccattaccaccatccgagtccaagttaccatcacctcagacctggacaaccacagaagcctcctcactggtctctctgtttccatcttggccctccttcagtcaattttctatatggtagccagagcaatttggaaaaagcactgtgtctttcactctaaaataaccgatgtcctgtgtatagttgctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaa

SEQ ID NO: 437794 - DNA, 360 bp, Homo sapiens
cagttcaagttcgaggtcaacgaaatctcctggaacaatgacaataatatgttcttcctgacaaatggcaatggttgtatcaacatcctcaggtgagggggtctagcttaggggactgtcatgtctttgtgctgggtgctgtgtcagatatggagatgaattagatgtgagcctatcctgaaggagcttaaaacacaaatagtaagagagaatcctaacctgtcttaagtacatttgagctgtatattttatatactttatattttactgagtccttacagaaattctaggggttgatgatttgcttctcatttgacagatgaggatctgagggtgagaggttacatcagtagtcagcta

SEQ ID NO: 437795 - DNA, 1856 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaaaaaaaaacatggttactcagtcaggg

SEQ ID NO: 437796 - DNA, 1871 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaaataactacttataatttttcttcttttcttgcttctcctct

SEQ ID NO: 437797 - DNA, 1893 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctggtcaggctgcgcatttcgttcttttgctttgtctgtgtattagctctttccattctttgcccccagcatgagttaactcgcgtggactctgcagtgcgagtagtgaccccagcataccttgtcctctggacctcctgtcttctctgcttctgggtgcatggtagactttgtggcatttgatacaacttggacaatacctagtttggagggaggggaatggaagggcatggaagtttttttaaataattaaaaatatatacatataattttgagaattgagcatttaataaactgacttttgttattatggaactcgttaattactggcaaaacaaacaagaagcacaacaaaaagaaaacaaaagtggggcacgc

SEQ ID NO: 437798 - DNA, 1542 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacaggggacaaactatgggaggtacagtgtgagtctccgaccttcacagtggcgtggcaccccaaaaggcctctgctggcatttgcctgtgatgacaaagacggcaaatatgacagcagccgggaagccggaactgtgaagctgtttgggcttcctaatgattcttgagaggaggttgtagggagaggaggccccggcagaggtcttccttcatgtggttagtttggtctgttctctcggagttggtgggcaccctaaatatttgtaagttggtataaattgtaaacgtctctgaccaagctaaggatcctgtgacca

SEQ ID NO: 437799 - DNA, 1411 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccaggctggattggcctgtaagaaccctcagtttcagccatgatgggaaaatgctggcgtcagcatcggaagatcattttattgacattgctgaagtggagacagtccaacagacacactcagcctcccagaaagcagctggccccctggccaagaggccagtttgcagcatcgtgatcattccaccatctttgctgccatttgaatcttgaatcagctttgtgtacctgtaataaattccacttagccatggcatgtagttttttaaaaatacattgttgaatttga

SEQ ID NO: 437800 - DNA, 1166 bp, Homo sapiens
tgtttagaaggttagtgttggttcttttattcgattaaacaggaatacacatatgtctaccaaagaataggtaagggagaaataagaacactaaaaaaactcggaatcgttaagtgtgaagcatatttggagttaaaagaaccaaatattactaagtaagcagacgcgggcacgcgctgcataccgggatttgtagtcccttccggggcggggtacagcgcgcctgcgcagaggggccgtcgctcttccgggcgcatgcgtgcggcagcggcgccaggactgactgcgccgtggaggctgctgcagtgttgtgagttggaagctggggagctcggcatggcggtccccgctgcagccatggggccctcggcgttgggccagagcggccccggctcgatggccccgtggtgctcagtgagcagcggcccgtcgcgctacgtgcttgggatgcaggagctgttccggggccacagcaagacgcgcgagttcctggcgcacagcgccaaggtgcactcggtggcctggagttgcgacgggcgtcgcctagcctcggggtccttcgacaagacggccagcgtcttcttgctggagaaggaccggttggtcaaagaaaacaattatcggggacatggggatagtgtggaccagctttgttggcatccaagtaatcctgacctatttgttacggcgtccggagataaaaccattcgcatctgggatgtgaggactacaaaatgcattgccactgtgaacactaaaggggagaacattaatatctgctggagtcctgatgggcagaccattgctgtaggcaacaaggatgatgtggtgacctttattgatgccaagacacaccgttccaaagcagaagagcagttcaagttcgaggtcaacgaaatctcctggaacaatgacaataatatgttcttcctgacaaatggcaatggttgtatcaacatcctcagctacccagaactgaagcctgtgcagtccatcaacgcccatccttccaactgcatctgtatcaagtttgaccccatggggaagtactttgccacaggaagtgcagatgctttggtcagcctctgggatgtggatgagttagtgtgtgttcggtgcttttccagctggatggccttccgtacctctcaactcagcccatgatg

SEQ ID NO: 437801 - DNA, 694 bp, Homo sapiens
aggggatggtgccttaaaattcactagactcccaggtagttgaacttcgtgaagaaagtggtaacctgagatgaggattgatgcctcctttactgggatgtacttctgagagccagacttaccttcgcacagccatagctccccaagaatagcattccctctcccaccaaaaaaacatccggatctcaattttcataccaggatgcttactgcagactgtaatcagtttcctggttgcaagatttctctctgctcgttggcaagtcagcctctcagaagatatgataactacatctgtagatgatttgtacaatgttgggggtgggcagtggaccccagtggtttatgctcatgcttgccattctgtccctgaagacacagttccttgagtccagaagatttttgttttttgtgacattccttttaaaaatggctgtattcctgggagggggtcacccagggagcagttaccaaccaacttctaagcaaatctctccacggccagaggttatcttttttaaggcgtctagtggaatggatgagtgtgcctgagaaggatgggaaaagagatgtcagaaataagaccaggggctgagagggaagaagatatgtgagggagcagccagaacttgagccagtctcttcctcttgtccctttcctccgatcaccccaggaactggcctcccacctccc

SEQ ID NO: 437802 - DNA, 545 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437803 - DNA, 569 bp, Homo sapiens
agacgacgaaggacggcgcgagaagacgacagaaggttacggtgcgagaagacgacagaagggagggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437804 - DNA, 557 bp, Homo sapiens
tgattcgatttatcgcccatatagggattggcctgaggcaagatcggcacgagggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437805 - DNA, 547 bp, Homo sapiens
  misc_feature (26)..(26): n is a, c, g, or t
  misc_feature (38)..(38): n is a, c, g, or t
aattcgccgccggtcgacacggcgcnagaagacgacanaggggggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437806 - DNA, 786 bp, Homo sapiens
  misc_feature (594)..(594): n is a, c, g, or t
  misc_feature (598)..(598): n is a, c, g, or t
  misc_feature (600)..(600): n is a, c, g, or t
  misc_feature (609)..(609): n is a, c, g, or t
  misc_feature (624)..(625): n is a, c, g, or t
  misc_feature (627)..(627): n is a, c, g, or t
tgattcgatttatcgcccatatagggattggcctgaggcaagatcggcacgagggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaaaaaaaaaaaaaaaaaaaaaaaaactgtgtggggnggcntngggccctgnaaaaaggtttttaanncncttctgttggggcgggccccatagtgaaggtagacttgccacgctgttccaagagacctggctacgcagtggtggttccccaataaaacgcgggggaccggcgtttggacatcaaggggtcgggctcggtctcaagtcacgtctagcccgcgggtgtgc

SEQ ID NO: 437807 - DNA, 763 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaatataataaatattctcgtctctctgactctataccaccatggtcgcaattattatcttctatacccactacgttaaaagaacattgtcgcccgcttggcccagcacgatttaccttgggcaggtttatgattgcggcccattttgagctcattgggcttccgcctaatggggggcgtttaacatataactggccggtgtttccgtcgtggctggg

SEQ ID NO: 437808 - DNA, 610 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaacaaacaatataatcaatttatttcaacaatcactggccgtctttttacaacgtcttgactgg

SEQ ID NO: 437809 - DNA, 491 bp, Homo sapiens
tgattcgatttatcgcccatatagggattggcctgaggcaagatcggcacgagggaccactgcagactgagcggtggaccgaattgggaccgctggcttataagcgatcatgtttctccagtattactcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437810 - DNA, 491 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgaggctcgttaatcttttacgctgctcatgcctcggctattatcagcaaccaaacgcgtcaatctgtaagcttgaagcttcccatgctgtttggaatcctatctcatcaccacgtgaatgagtctatactgatgggctcgcggttatatgaacaatattttcttcttttttcatgccagttattaaagatatagtgactga

SEQ ID NO: 437811 - DNA, 319 bp, Homo sapiens
tttttcaaatcattttatctttaataatcttgtagtaatttaaaatatgagaaaaaaaagtcaaatgtgtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactct

SEQ ID NO: 437812 - DNA, 1380 bp, Homo sapiens
agacgacgaaggacggcgcgagaagacgacagaaggttacggtgcgagaagacgacagaagggagggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaaaaaaaaacaaccaaacaaaacaacaaaaaacaaaaaaaacaaaaaaaaaaaaaaaaaaaaaaaaaaaaaaaaaacaaaaaaacacaacacacaaaaaaaaaagcggcggcgcgcggccccccaactctcccccgcgggccccccaccacccccccccttcttaccaccgcgccccccacagtagtgggtgggatgtattattattatatatccgccgccaggggttgctgttcttattaaacacacacgcttcgtgcggggaagaatccatactcgacttacgtcgcagtgttctatgggagagaagaccacacctctattcctgggggagggcgcaatacaaacatgtcgagaggaaataacgtcactcgatcagtaatatcttattgcactacactagggataacataaagcagacttgagtcgcggtggtttactttcgtgctggtgtcacacaccacgacccaggattgatggctggcggcttagcgactcagacgacatttttgcacgagcgacaggaggttcttaatacttacgactaacacctatctattcgcgcgcgaggagcgggttctatcaatagaagaataccaactcacaactcgcgcaacaccccatatcacagacagcaagaggtgcagatatcatacgccagacctaggatctggacaccaccccctaacttcctccaacaccagcagcacgtctgctaccgcgatatcaacgtaacaggttcgtccaacgcgacggccacgcaccactgcagcagtaagaacgtcaaccaccgcatctgcaaccacactcc

SEQ ID NO: 437813 - DNA, 244 bp, Homo sapiens
ggaccactgcagactgagcggtggaccgaattgggaccgctggcttataagcgatcatgtttctccagtattacctcaacgagcagggagatcgagtctatacgctgaaggtgaggagagaaaacagggtgtaaataggcatggcgagaaatgtagatgggaggagtgggtgaggtcatacgtggagttacctagctgggtgcggggaaccagaaagtccagaaccgaggtggggaagaaccgg

SEQ ID NO: 437814 - DNA, 1356 bp, Homo sapiens
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaaaaaaaaacaaccaaacaaaacaacaaaaaacaaaaaaaacaaaaaaaaaaaaaaaaaaaaaaaaaaaaaaaaaacaaaaaaacacaacacacaaaaaaaaaagcggcggcgcgcggccccccaactctcccccgcgggccccccaccacccccccccttcttaccaccgcgccccccacagtagtgggtgggatgtattattattatatatccgccgccaggggttgctgttcttattaaacacacacgcttcgtgcggggaagaatccatactcgacttacgtcgcagtgttctatgggagagaagaccacacctctattcctgggggagggcgcaatacaaacatgtcgagaggaaataacgtcactcgatcagtaatatcttattgcactacactagggataacataaagcagacttgagtcgcggtggtttactttcgtgctggtgtcacacaccacgacccaggattgatggctggcggcttagcgactcagacgacatttttgcacgagcgacaggaggttcttaatacttacgactaacacctatctattcgcgcgcgaggagcgggttctatcaatagaagaataccaactcacaactcgcgcaacaccccatatcacagacagcaagaggtgcagatatcatacgccagacctaggatctggacaccaccccctaacttcctccaacaccagcagcacgtctgctaccgcgatatcaacgtaacaggttcgtccaacgcgacggccacgcaccactgcagcagtaagaacgtcaaccaccgcatctgcaaccacactcc

SEQ ID NO: 437815 - DNA, 774 bp, Homo sapiens
  misc_feature (582)..(582): n is a, c, g, or t
  misc_feature (586)..(586): n is a, c, g, or t
  misc_feature (588)..(588): n is a, c, g, or t
  misc_feature (597)..(597): n is a, c, g, or t
  misc_feature (612)..(613): n is a, c, g, or t
  misc_feature (615)..(615): n is a, c, g, or t
ggccacgaggggaaattgacgaacacgtgacgcggtcgggcggaccactgcagactgagcggtggaccgaattgggaccgctggcttataagcgatcatgtttctccagtattacctcaacgagcagggagatcgagtctatacgctgaagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactctaaaaaaaaaaaaaaaaaaaaaaaaaactgtgtggggnggcntngggccctgnaaaaaggtttttaanncncttctgttggggcgggccccatagtgaaggtagacttgccacgctgttccaagagacctggctacgcagtggtggttccccaataaaacgcgggggaccggcgtttggacatcaaggggtcgggctcggtctcaagtcacgtctagcccgcgggtgtgc

SEQ ID NO: 437816 - DNA, 1458 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatga

SEQ ID NO: 437817 - DNA, 3370 bp, Homo sapiens
  misc_feature (2788)..(2788): n is a, c, g, or t
  misc_feature (2827)..(2827): n is a, c, g, or t
  misc_feature (2840)..(2840): n is a, c, g, or t
  misc_feature (2856)..(2856): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437818 - DNA, 1336 bp, Homo sapiens
gaaaccattagctagtacgaggcctggtgtgcgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatga

SEQ ID NO: 437819 - DNA, 2067 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagacacgtacatgagtcagagcaaatgggggtaaaaggtaagatgtgctacaagagggctctggatagagtgctggaagaatcaggaaagttttgtagaatgggttgtttcatctgaatttaaaagggtatgtaggattttaacatgagaatttcacgtgagaattcaagtgaaaactcaacagtgtgagtaaagataacaatggcgggaatgcttagactgaggggtggtaatgcatttaaatggggcataggacgtctggggtttggagaggaataaagtgggttgggtcggctggtgggtggccttcacaggcacgcaaagtagttacatacagtctgcaacagaacagggatgtttcctcggaattctgcttgagaaacgccagtctggctatagtgtgtaaggcagataagcagggatggggacacgaacggagacacagactcataatcagttgaagatgagggtgagggaaggtaagttaggttctcctttgaggtgcccaggacataggaacgtttaagggcaagagaagtctgtcttgcaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatga

SEQ ID NO: 437820 - DNA, 3565 bp, Homo sapiens
  misc_feature (2983)..(2983): n is a, c, g, or t
  misc_feature (3022)..(3022): n is a, c, g, or t
  misc_feature (3035)..(3035): n is a, c, g, or t
  misc_feature (3051)..(3051): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437821 - DNA, 1110 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatggcttcttttgctgggcctccttgagtttttcctctgccgccacctaagttcagagccagg

SEQ ID NO: 437822 - DNA, 1373 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtaagactccatccccccaccccatcccatccccataaatcagggattttagagaaggcataccctatgcagtcctctgcaaccctgggggagtgcttgggaattgagggcagccacccccattccttatcaggcctgactctaccatgctggtttacagctggctgggctggcattcacaggagcagagaacagtcccaggctgtgagggtagcaccagcgctagaggttcgcacagctcgtgctgtccagaagttattattgaatctgcattcgtggctgagggtttttttttgtttttttgttttttgagacagagtctcactctgcagcccaggctggagtgcggtggcgtgatctcatc

SEQ ID NO: 437823 - DNA, 1389 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagacacgtacatgagtcagagcaaatgggggtaaaaggtaagatgtgctacaagagggctctggatagagtgctggaagaatcaggaaagttttgtagaatgggttgtttcatctgaatttaaaagggtatgtaggattttaacatgagaatttcacgtgagaattcaagtgaaaactcaacagaggagccattttgagcaatggggaacgctcacggactgtgtggtaatgagagatccaaacaccaagcgctccaggggctttgggtttgtcacatatgccactgtggaggaggtggatgcagctatgaatgcaggccacacaaggtggatggaagagttgtggaaccaaagagagctgtctccgagaagattcacaaagaccagtcccactaacttgaaaaaatgg

SEQ ID NO: 437824 - DNA, 2903 bp, Homo sapiens
  misc_feature (2321)..(2321): n is a, c, g, or t
  misc_feature (2360)..(2360): n is a, c, g, or t
  misc_feature (2373)..(2373): n is a, c, g, or t
  misc_feature (2389)..(2389): n is a, c, g, or t
cacagcaagactccatctcaaaaaaaaaaaaaaaaaaacaactttatgacatgggaaactgcttatgccaagtgaggaaagtgcagttcataattgcatgtcgttttttaggataatcatagtaggggaaagaactagattgcagcatctgaagatataagtgggtgatatttgtgactccttattagttaaggaaacattttaataagaggtttttagctgaggcctgaagttagggaagagaacaggccaggaactatggaacaggtctctctggcctaattagtcaggtatacccactgatgtcactttccttccaggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437825 - DNA, 2712 bp, Homo sapiens
  misc_feature (2130)..(2130): n is a, c, g, or t
  misc_feature (2169)..(2169): n is a, c, g, or t
  misc_feature (2182)..(2182): n is a, c, g, or t
  misc_feature (2198)..(2198): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccattctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437826 - DNA, 2469 bp, Homo sapiens
  misc_feature (1887)..(1887): n is a, c, g, or t
  misc_feature (1926)..(1926): n is a, c, g, or t
  misc_feature (1939)..(1939): n is a, c, g, or t
  misc_feature (1955)..(1955): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaaggtgaggccaggtccctccaggtggattgggaaccacctgacagccccctctgtctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437827 - DNA, 1346 bp, Homo sapiens
  misc_feature (764)..(764): n is a, c, g, or t
  misc_feature (803)..(803): n is a, c, g, or t
  misc_feature (816)..(816): n is a, c, g, or t
  misc_feature (832)..(832): n is a, c, g, or t
aaaacttttccaactgcgtatctgtgtgaagtcaacttacttcaacaaaaaagtttggatgtagaagcagctgtaagaattcaactgtttattataacaagatactaaagagactgtaaaatgccacccttctccttggattgttttggaagttattcttcataaaaaatgttaacgtgggctgggcatggtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437828 - DNA, 335 bp, Homo sapiens
aatgaggtcaagtcagtggcttgggccccatctggcaacctcctggccacttgcagccgagataagagcgtttgggtctgggaaggtgaggccaggtccctccaggtggattgggaaccacctgacagccccctctgtgtccctgacagggtcggctcttgggtcccctttttctctcccacagttgatgaagaggatgagtatgaatgtgtcagtgttctcaactcccacacacaggatgtcaagcatgtggtttggcacccaagtcaggaggtaagagtcaagcagggactcttgtgggaagggctctggtgtgcaggcttgtgcccagcctt

SEQ ID NO: 437829 - DNA, 3592 bp, Homo sapiens
  misc_feature (3010)..(3010): n is a, c, g, or t
  misc_feature (3049)..(3049): n is a, c, g, or t
  misc_feature (3062)..(3062): n is a, c, g, or t
  misc_feature (3078)..(3078): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437830 - DNA, 4201 bp, Homo sapiens
  misc_feature (3619)..(3619): n is a, c, g, or t
  misc_feature (3658)..(3658): n is a, c, g, or t
  misc_feature (3671)..(3671): n is a, c, g, or t
  misc_feature (3687)..(3687): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggtgaggtccattagtagagctaaagaagacccatctctcaaggggttcacagtctgctaagacacgtacatgagtcagagcaaatgggggtaaaaggtaagatgtgctacaagagggctctggatagagtgctggaagaatcaggaaagttttgtagaatgggttgtttcatctgaatttaaaagggtatgtaggattttaacatgagaatttcacgtgagaattcaagtgaaaactcaacagtgtgagtaaagataacaatggcgggaatgcttagactgaggggtggtaatgcatttaaatggggcataggacgtctggggtttggagaggaataaagtgggttgggtcggctggtgggtggccttcacaggcacgcaaagtagttacatacagtctgcaacagaacagggatgtttcctcggaattctgcttgagaaacgccagtctggctatagtgtgtaaggcagataagcagggatggggacacgaacggagacacagactcataatcagttgaagatgagggtgagggaaggtaagttaggttctcctttgaggtgcccaggacataggaacgtttaagggcaagagaagtctgtcttgcaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437831 - DNA, 3514 bp, Homo sapiens
  misc_feature (2932)..(2932): n is a, c, g, or t
  misc_feature (2971)..(2971): n is a, c, g, or t
  misc_feature (2984)..(2984): n is a, c, g, or t
  misc_feature (3000)..(3000): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggacctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437832 - DNA, 3373 bp, Homo sapiens
  misc_feature (2791)..(2791): n is a, c, g, or t
  misc_feature (2830)..(2830): n is a, c, g, or t
  misc_feature (2843)..(2843): n is a, c, g, or t
  misc_feature (2859)..(2859): n is a, c, g, or t
gaagtagattcatttgcatctttgtaaaagctgtgaaatacactccctgagctttcccccactagcttgattccagtgctagcccctgatattgaatggcttcatggtgctgcacccagctccagagcctggcctgcgctccgcctttaggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437833 - DNA, 1386 bp, Homo sapiens
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgtcgggccgacatgaaggactcgctggtgctgctgggccgtgtcccggcgcacccggactcccgctgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccacttgcatttggaagaagaaccaggatgactttgagtgtgtaaccactctcgagggccatgaaaatgaggtcaagtcagtggcttgggccccatctggcaacctcctggccacttgcagccgagataagagcgtttgggtctgggaagttgatgaagaggatgagtatgaatgtgtcagtgttctcaactcccacacacaggatgtcaagcatgtggtttggcacccaagtcaggagctcttagcttctgccagctatgatgacacagtgaagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtaagactccatccccccaccccatcccatccccataaatcagggattttagagaaggcataccctatgcagtcctctgcaaccctgggggagtgcttgggaattgagggcagccacccccattccttatcaggcctgactctaccatgctggtttacagctggctgggctggcattcacaggagcagagaacagtcccaggctgtgagggtagcaccagcgctagaggttcgcacagctcgtgctgtccagaagttattattgaatctgcattcgtggctgaggcaggagaatcgcttgaacccgggaggcggaggttgcagtgagccgagattgcgccactgcactccagcctggtgatggagcaagactccatc

SEQ ID NO: 437834 - DNA, 2898 bp, Homo sapiens
  misc_feature (2316)..(2316): n is a, c, g, or t
  misc_feature (2355)..(2355): n is a, c, g, or t
  misc_feature (2368)..(2368): n is a, c, g, or t
  misc_feature (2384)..(2384): n is a, c, g, or t
ggtatgctgtgccacccagtcatcctcttcctcccggtacagcttcactgtgtcatcatagctgtaccgggaggaagaggatgactgggtatgctgtgccacccttgagggccatgaatccactgtgtggagcttggcctttgacccgagtggccagcgcctggcgtcttgtagtgatgaccgtactgtgcgtatctggcgtcagtatctaccaggcaatgaacaaggggtggcatgcagcggctctgaccccagttggaaatgtatctgtactttgtccggcttccactcaaggaccatttatgacattgcttggtgtcagctgacaggggctctggccacagcttgtggggatgacgcgatccgcgtgtttcaggaggatcccaactcggatccacagcagcccaccttctccctgacagcccacttgcatcaggcccattcccaggatgtcaactgtgtggcctggaaccccaaggagccagggctactggcctcctgcagtgatgatggggaggtggccttctggaagtatcagcggcctgaaggcctctgagctacctcgactttggacagagtaatgactccccagaaaacgtcatataagactttaccagcccctgagaggaccaggaggagcatccttgaccttcatttaacttggctcacttctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437835 - DNA, 2646 bp, Homo sapiens
  misc_feature (2064)..(2064): n is a, c, g, or t
  misc_feature (2103)..(2103): n is a, c, g, or t
  misc_feature (2116)..(2116): n is a, c, g, or t
  misc_feature (2132)..(2132): n is a, c, g, or t
cgcgatgctttccctgccgaggtgaggggagcgactacaactcccagagggtatggcggccgcagcagtgggcagttgagtttccggggcgacccaggtcctccggcggaagcgggagcctctgtcggccgcggaagcctggagtgggcggtacgcagacgcgcgcggtgagacccgctgtctgctcagcggactctgcccgcccccacctccccctgcgctggttcctggcctggaaccccgcggggaccctgctggcctcgtgcggcggcgaccggagaatccgcatctggggcacggagggtgacagctggatctgcaagtctgtcctttctgaaggccaccagcgcaccgtgcggaaggtagcctggtccccctgcggtaattacctggcctctgccagctttgatgctaccattctcttcagacttgggtagaagtgcagagccacagaattgctttccttccccgcctttgacatgaggccttcagtaaagagctacagaacatgagtacattgttataccacagatttttcttgcattagggcacagtgttaaattttttggaggtaaatatactatttataatcactatatatagtaggagggggtatgtgtctcaggcttttctgaagttgcaagacttaaagaaataatccatctgcatcccaagtcctattttataaggatattcataaaaattccatggtgaatccttgtctgaaataggtcctcccttcccagtttctgtgtaagtctttgcatttaagacatccaatcaataatgaaggaaatttttttctgaatgtaggtttgagtgaggggcacctctgctttcccttagcaaccctcatatacctccctgcaccgttacgctgtgatggcaactggggatagaaaaaaaatggggaaagacaggaatcctaaaagggagagttattactggccacaagccctgtattctcaacagggatgcaaattggttcttcagtaaggataaaaaaaatcacaagcagttgtttgtggccctcctaaggcccacagcacatatagtgtgtctgtgatattccattttcatggcaggagtgatcaggaagaaggcttcctaggggactggcgatttaaaccagttgagaaacactgccatcagcaggcagtttcagactcactcaagttgtctcttgacagtcacttctaaatgggttctaatgtgacaatggcctccaaaactacagccttccctgaagtttaagctgtgaccttagattttagaaggacagtggggctgtacctagaatagtggttctcgaagaatgcggcctgcagatcctgggagtcccaagaccctttcagggaggatctgtgaggtcaactgttggcactgtggcatgaatcaaggtggtggcagcaaacttctagtagttttgatatgtccttgatagaacaaatagcaatggttaactattaaatgttgacctagccagcgcagtggctcatgcctgtaatcccagcactttgggaggctgaggcgggcggatcacctgaggtcgggagttcgaggccagcctgaccaacatggagaaaccccgtctcttctaaaaatacaaaattagctgggcatggtggtgcatgcctgtaattccagctactcgggaggctgaggcaagagaatcgcttgaatccggtaggtggaggttgcagtgagccgagatcataccattgcactccagcccaggcaacaagagtgaaaccctgtctcaaaaagaaaaaaaaagttgaccttgagaatttataatattctgagaaaactggaagcatgcataaagcccctctgctgtgcactgaagtatgggtgccttgaggaaaagcagttacacagttgagttgcaagctgaattggctgtgttcaaggcatgccctttagaattgaaagaactagcagattacggtatttagacttgaatatttggctgatattttctggaaattaatggaatgagcctctcacctcaagggaaacaactgatagtgttgccagtgataaagctttcaagcaaaaatnggaatttccgaaaatctgtactccaccatgagctttatngtggggatattancaaatgtgattgtatnatgaaatgcatttcattggagaattcaatgaaccattttccagtgaccagtacgtgatgttacaaaatcatgcatggctcaaagattgattcaaaagtgtaagacaggccagtggatcttaatgtattaacaatataagagtgcattaagtcctcggagtctacattgcctttaagaaactatgacttgtagtaagccgggcgcggtggctcacgcctgtaatcccaacacttcgggaggccaaggtgggtggatcacaaggtcaggagtacaagaccagcctggccaatatggctgaaagtccgatctctactaccaattacaacacaattagccgggccgtggtcggcagatccctatgtagtcccagctactcggcgaggctgcaggcaggacgaatagccttgaacccggagacgtgcacggtcgccgggagacgcacatcgtgcccactggactccaggcatgggaagacagcaccgcagacaccaacccaaaaaaacaacaaacacac

SEQ ID NO: 437836 - DNA, 1110 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttgctgggtgcagtggctcacgcctgtaatcccagcactctgggaggccgaggcaggaggatctcttgaacccaggagttcaagaccagcctgggcaaccttgtctctaca

SEQ ID NO: 437837 - DNA, 598 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttactctgggaggccgaggcaggaggatctcttgaacaaaattcactaattttaagggtccagtttga

SEQ ID NO: 437838 - DNA, 820 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccgccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctggtaagaaagactggagcttgtgttcgcccactgcctccagccctcagcaaagaaggccacctgtgtggggcagtatacttgcttcttctctctctcccagccctacttccttcctagattctctaagatcttgaggactcaggaactgcca

SEQ ID NO: 437839 - DNA, 377 bp, Homo sapiens
aataaccaccaccccaatcaaaataggtaatattttcatcaccccagaaagttccctcctgcctccttttccagtcaatcccactagacgtaatcactgttctgatctatggattatttttggctattcttttacttcatataagtgaaatcatatagtttataatcttctgtatctggcttttttctcccaacacagtgttttggagattcatccatgttgttgcatgcattcatagcttgtgcctttttattacttggtagtattcggttgcatgaataagttactatttgcttatctgttcacctgttgatgaacatctgaattgtttccatttgaggactattatgaataaagctactttaagcattcatgta

SEQ ID NO: 437840 - DNA, 2281 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaagggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437841 - DNA, 3127 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggtagtgggaaccccaaagcaggaactgagccagggagtgggttgcctagatttctagagaggaggtgagtgagaggatagttcagagaatgagagcagcagaggcactgataagaaggaaggggaggagggagtgcttttcaattatcaaaacagaagggagggggaagaagtttgcgggggaatggggtgcttgttgctgaaaagggcatttggggaatcagaattccctggggggttgagttattggattccagagtggaactaaggaacctgcatgcatgttccattcatcctgcttcaaccctctcccactgccaggccacttggccagccttgttggaagtgttcaggcagcctactgaactcttgctgtgcttagcttgggctcttcctaactcctccctgatggacaaaagtttcaccaacccattatgttcttattcactgtttcttctcccactgcagagatgctgcctgggaactcgagccaggggctttctcagacttatatcagcgctatcagcactgtgatgcccccatctgtctgtatgaacaaggcagagacagctttgaggatgaagggtaggggaaggcttctggctagaaagagctctcatcagtgctatcttagagttagaccttggcacagttattagaagtaagaaattcactcttgtatgcagaccttaggataaacacgattgctaagtctcattcttgaccagcccgactcacttgtgtgcacgtgaacacgtctcccctgcaaggtccgcttcaccttgtgcccagtggagagacattcagagccaattcctttcctaatctacctttcaaggggttacgactgatggcaggcttctgggatcagcactcatcctctctgagccatacattcatcttgggtaaaatgtgctgtaaaaaatgcctggcccatagcaaacatccaagcatggcagttggtgttctgtatgtctccacaacccttcctgggctcttcctctaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgttctgtatgtctccacaacccttcctgggctcttcctctaggaggtggtgcctcattctgtgtgctacatgcggatcccacggaacccacagggactgctcctctcttagatctaacagtaagaaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaaaaaaaa

SEQ ID NO: 437842 - DNA, 2119 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacaactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437843 - DNA, 1863 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagagatgctgcctgggaactcgagccaggggctttctcagacttatatcagcgctatcagcactgtgatgcccccatctgtctgtatgaacaaggcagagacagctttgaggatgaaggggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437844 - DNA, 1717 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacaggtggggctttttccgccctgggtcccttccaccattgccctagttctctgcctggaaccagagaaccctgggaatgctcaggtgtgcctcagctttggtgctccatgctggaggcctgtattgagggctggtttcaggcagttagaggaaagtcagtccagtctgtggtcattcctggcctataggacctcacacatgataagatttagaataagcaaaatcttcagcattgctagagcaaatgggctcatcccagaatgagctgagaagcctctatgtcagcctcacttcctgggatgaaagaaaagggaaacatgtatccaggtggc

SEQ ID NO: 437845 - DNA, 1180 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtctttgttttggagattcatccatgttgttgcatgcattcatagcttgtgcctttttattacttggtagtattcggttgcatgaataagttactatttgcttatctgttcacctgttgatgaacatctgaattgtttccatttgaggactattatgaataaagctactttaagcattcatgta

SEQ ID NO: 437846 - DNA, 2256 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaaggttttatgtctattgctggatggtcggggtagccccagtaactgggaactgctccgcagtccgctcacgtggacccctgtgggaatagcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437847 - DNA, 2123 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437848 - DNA, 1471 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagggtagaagtagttgacatagggaatttgggagaaattgtccaatggcctgtggtataggctgcactttttgccccctttgtcgtagtcttgggggttgaggttggaccagtgtggaagcacacacggagctgggagctgtcatacctgtcttaccagtgctgtccctagtagcaaagtgctgactctggaaccttactacccaaattcatatcctactctgccacttgccaataactgtgacagaaggcactacatttctttatgcctcagtttcctcatctggaaaatgtacataataatggcatgtactttttagagtgttctgtagattcattgagctactgtagattaattgagccaatacatgtaaagtgccaagaatagtgcctcgcaacaggaaatacttttatcaattttggttcatttcagtatgctttgtaaaggtggtaccacctgagattcagagtagttggcagaagaagcagtaaaaaagtaaaagagggtttgctcttgcattcattcagtcaacataggcagtacaggcactggggagagaaagatgcttacaatccggttcctgccctcaaataactcagtgagtatgttttgcactt

SEQ ID NO: 437849 - DNA, 2121 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437850 - DNA, 1860 bp, Homo sapiens
ctccttttcctgtaccctcaaactctcttagcaacatcctctttgtaggggtgagggtgggaggagaaagaaggtagtcaaagggtttttacaaacacagagctcttccctgtttctcttacagaaatatgcccacacatcagcaaagcatttcttcaaatgtccacagtgtaacaatcgaaaagagtttcctcaagaaatgctgagaatgggaattcatattccagacaggtagtgggaaccccaaagcaggaactgagccagggagtgggttgcctagatttctagagaggaggtgagtgagaggatagttcagagaatgagagcagcagaggcactgataagaaggaaggggaggagggagtgcttttcaattatcaaaacagaagggagggggaagaagtttgcgggggaatggggtgcttgttgctgaaaagggcatttggggaatcagaattccctggggggttgagttattggattccagagtggaactaaggaacctgcatgcatgttccattcatcctgcttcaaccctctcccactgccaggccacttggccagccttgttggaagtgttcaggcagcctactgaactcttgctgtgcttagcttgggctcttcctaactcctccctgatggacaaaagtttcaccaacccattatgttcttattcactgtttcttctcccactgcagagatgctgcctgggaactcgagccaggggctttctcagacttatatcagcgctatcagcactgtgatgcccccatctgtctgtatgaacaaggcagagacagctttgaggatgaagggtaggggaaggcttctggctagaaagagctctcatcagtgctatcttagagttagaccttggcacagttattagaagtaagaaattcactcttgtatgcagaccttaggataaacacgattgctaagtctcattcttgaccagcccgactcacttgtgtgcacgtgaacacgtctcccctgcaaggtccgcttcaccttgtgcccagtggagagacattcagagccaattcctttcctaatctacctttcaaggggttacgactgatggcaggcttctgggatcagcactcatcctctctgagccatacattcatcttgggtaaaatgtgctgtaaaaaatgcctggcccatagcaaacatccaagcatggcagttggtgttctgtatgtctccacaacccttcctgggctcttcctctaggaggtggtgcctcattctgtgtgctacatgcggatcccacggaacccacagggactgctcctctcttagatctaacaactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437851 - DNA, 2164 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437852 - DNA, 2042 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437853 - DNA, 1599 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgccaaattttttgcgagagtacaaaccattttgtgacaacatcgcccaacacagcacacccaacatgggcatgtggggaggaaagctgcagtctattgttgtgaagacttatcccaacagtagtgttgagaaca

SEQ ID NO: 437854 - DNA, 2982 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagatgttttgaagatcgtgacgtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggtagtgggaaccccaaagcaggaactgagccagggagtgggttgcctagatttctagagaggaggtgagtgagaggatagttcagagaatgagagcagcagaggcactgataagaaggaaggggaggagggagtgcttttcaattatcaaaacagaagggagggggaagaagtttgcgggggaatggggtgcttgttgctgaaaagggcatttggggaatcagaattccctggggggttgagttattggattccagagtggaactaaggaacctgcatgcatgttccattcatcctgcttcaaccctctcccactgccaggccacttggccagccttgttggaagtgttcaggcagcctactgaactcttgctgtgcttagcttgggctcttcctaactcctccctgatggacaaaagtttcaccaacccattatgttcttattcactgtttcttctcccactgcagagatgctgcctgggaactcgagccaggggctttctcagacttatatcagcgctatcagcactgtgatgcccccatctgtctgtatgaacaaggcagagacagctttgaggatgaagggtaggggaaggcttctggctagaaagagctctcatcagtgctatcttagagttagaccttggcacagttattagaagtaagaaattcactcttgtatgcagaccttaggataaacacgattgctaagtctcattcttgaccagcccgactcacttgtgtgcacgtgaacacgtctcccctgcaaggtccgcttcaccttgtgcccagtggagagacattcagagccaattcctttcctaatctacctttcaaggggttacgactgatggcaggcttctgggatcagcactcatcctctctgagccatacattcatcttgggtaaaatgtgctgtaaaaaatgcctggcccatagcaaacatccaagcatggcagttggtgttctgtatgtctccacaacccttcctgggctcttcctctaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgttctgtatgtctccacaacccttcctgggctcttcctctaggaggtggtgcctcattctgtgtgctacatgcggatcccacggaacccacagggactgctcctctcttagatctaacagtaagaaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaaaaaaaa

SEQ ID NO: 437855 - DNA, 2144 bp, Homo sapiens
ggggcgggtgttgggcgctgaggcgcgagaggaggggatgggcggggcgcgcggccgttagcgcgcggccgttagcggtcggtttctactaacggtaggcgtcgccgcgattcccgaaggtcatagtccgcgtgacccacccccgtttgcgcgctcgcagtcttcgccggcgcagtcaccgcgcagggcggccgcccggaggtagctaccacggcctgtgtcaacgactaaagctccagtacagcggcgccctcagacagctgggagggtggctctggccgggagcggcggccggtgagctaccgcgaggaggagcggcggaggcgacctcggcccggccctgcactggccgcccggcaggcgcgacatgagcctggtctggcatccgcgggatgctccttaagccccttctccggctgttaacctccggggaacggttgtgaccacaccgacacgtattttacagataaatcattcttgcggcggcgggtcgaacacgtttatttattttttattttctcaacaagcttttacccagcacctgtccagtgaaacaacttgataatcgtttcgaggggcgtccgccgggttaggaagccactgcctggcagcttgtggaagcctcatttgcaaagccacccctcagtcttgtaactagcagtgtgtgcacagaatcctactcaaggaacgtcttggcccagcgatgcaaagaactgaagtttcaagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437856 - DNA, 1776 bp, Homo sapiens
aagtaatggttctaagttcttttgctactgtgtgatagcagtataacatgagagttagtgttggcctctggagccaggctacttgagttcagatcccatctatatcacttactaactcttaccttgggcaggatacttaaacctctctgtgcctcagtcccccatcttgaaaatggggataataatggtacctactgcatggcgtgtttgtgagttaacacatgtcaagtacctagaacagtcccttttattccatcacatgggttgggaggtgaagtgcaccattgccttgaccctggggaacttgataaccaaatacagaattaaattgcttaccaaaccccatttatatttatagctggaagagcctgtattgtcctcacaatagtatagaagaattcaagagaggagagagagacagcaccgaatgaagactgtaaaagaaaagaaggaatgccagagattgagaaaatctgccaagactaggagggtaacccagaggaaaccgtcttcagggcctgtttgctggctatgccttcgagaacctggggatcccgaaaaattaggggaatttcttcagaaagacaatatcagcgtgcattatttctgtcttatcttatctagtaagctgcctcagaggggccagtccaacagaggtttccatggatttctgcctgaagacatcaaaaaggaggcagcccgggcttctaggaagatctgctttgtgtgcaagaaaaagggagctgctatcaactgccagaaggatcagtgcctcagaaacttccatctgccttgtggccaagaaaggggttgcctttcacaattttttggagagtacaaatcattttgtgacaaacatcgcccaacacagaacatccaacatgggcatgtgggggaggaaagctgcatcttatgttgtgaagacttatcccaacagagtgttgagaacatccagagcccgtgttgtagtcaagccatctaccaccgcaagtgcatacagaaatatgcccacacatcagcaaagcatttcttcaaatgtccacagtgtaacaatcgaaaagagtttcctcaagaaatgctgagaatgggaattcatattccagacaggaggtggtgcctcattctgtgtgctacatgcggatcccacggaacccacagggactgctcctctcttagatctaacagtaagaaatgggagtgtgaggagtgttcacctgctgcagccacagactacatacctgaaaactcaggggacatcccttgctgcagcagcaccttccaccctgaggaacatttctgcagagacaacaccttggaagagaatccgggcctttcttggactgattggccagaaccttccttattagaaaagccagagtcctctcgtggcaggaggagctactcctggaggtccaagggtgtcagaatcactaacagctgcaaaaaatccaagtaacaccttctgagtagctgctgtcccacacaatagggtatgaagctgcgctcctccatcgggtttggggagggagcactctgggactgtgagacaaggaagcagggccagcagtgagactatgagccaagcaaagagaagtctcagtggagcatgaggagggagcagtccagatgccaacaaggaaatgcgtttatggctacaagagtgcctctgctttctcctcctctcctcccaccaaggattcttccaccttaatcttgttttcatatgcctcttcttacttcacccatgtttgttgttatgcaaataaaggttttctc

SEQ ID NO: 437857 - DNA, 1288 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacattttta

SEQ ID NO: 437858 - DNA, 914 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaattccaaaaatttctggacggagggtattggacattcttaataaacgttcagatggcgcaattcgggtttggacatgcgtggggagtataacaatcggggttggtaccacgtgggttttgcttgtcctgtgttcgcg

SEQ ID NO: 437859 - DNA, 1408 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattcta

SEQ ID NO: 437860 - DNA, 1579 bp, Homo sapiens
tacatgattaaatcgagctctgtacctgaacattcgtgttcggcggctgcgtttcctgtccccaagccgttctagacacgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttccaatggatttgccttctcaaaatgtacaactaagcaactaaagaaaattaaagtgaaagttgaaaaata

SEQ ID NO: 437861 - DNA, 1836 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcggatgaagtgcaaaacaaacttctccatagaggagttgttgcaaagttccagtttataccaaacagtaatcagattccattggaagctaaagattttgagagccttttgtactatatgcaactaacttgatttcaagcttgggaacttttaaaaaaaacattaaagcaaaatgaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttccaatggatttgccttctcaaaatgtacaactaagcaactaaagaaaattaaagtgaaagttgaaaaata

SEQ ID NO: 437862 - DNA, 2751 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggttggagtgcaatggcgtgatctcggctcatcccaacctccacctcccgagatcgtgccattgcactccagcctgggcaatgaagcaagactccatctcaaaaacaacaacaacaacaacaacaacaaatgtatgagttggatgagtttaattttttgctttctgtttctgcctaaagataaaccaatttagcatatattgatattaagatgtctgccatattttgaatgttagcctgttgatttacagtcttccaaataagactgatgcctgaagctcattttttggttaactgcttctgttagttgcacaccttttcctaccttcctctaatcttaagtctatttagtcatttgaaatatcagttttcacctgttagtattactagctatgtttgctatatttcacaaatacatttctaaaacaatccattaattagaattggacattaatagtgaggcatgtcattctctgtaacaactaagattttaagtagaaattatttcactaattcatcttttatttctcaaagtattcaaggctaaaatttggagttctttaattttcattctaagaggcaagtattaattatactaatgagttcagatgtttttatttatttttcctcccaatgacctattcttaatgaacatggtattattaagagacattccagtgaatcatctcctgtatttttttacatgcataaattatattccctaaggccagactcttaaacagacagatgaacctaatagtctcaacaatgatttaaaaactggccctcaattttcttcattcattcctgatctcgtggagttgtggtcctttacttggttttaacacagtattcaacaaattgttgttatagttgataacatctactcattcttttacctgccttaaaaagtgtaataaaagtattcatacaaagtataaaatacatacaagtataaaaatgtataatacatttaatttacatgcatcttctacaatgacaagtatgatttctttagaaactgatgcatacattttcactgtttttctttcattatatatcagttttaatgcatactacttagaaattagaatcattttgagtttcttgaagagccttgataattatagtctcaaaattaaggaacctagacaaacaaagttaaaatatttatgacattttgcttgggcatacattcatatttccattaatatataattgctacattattaataagtgacatatttattataatgaaacacctccacgaatttagtgaattgtaattcttatctcttcctctgaagtattatacttagaaatacgtatcttcagttactgatttgggtacgacagggaacctggctggatatcattattatttgatatatgccatataaccttctgtttggggaatataaaatccctcaaattggaaatgttcatgactacccatgggataaatccagctgtttttgtttggggtccagagcataaaaacagaaaaggaaaaatgcagcttcccaacagaccactaccaaaccaccataacagacagtctgctagaagagaactgatcaggccattatgtcaccggacaacaggacaatcatctgagttgggatgctgaatcacggcaactccaagacatctgggattttttttttaccctcacattggatacaatctatggaatattactacatttagttcatttgtaatttacaatttttgatgactaaaattggaaaaggattagtacattcctactggctttacatattagtattgggctgtcaccattacccagattatttaaaatgtaaattttctttactcactagattggaagctccttaagagcaagggctacttctgtattattcatcttcatgccacgtcacttagaacctagtagatactcaataaatacctattgagctgaactgaccttgtctgagtaaaagtgagtccaatacacaagttactagattgtaggttggtttgacacaaacttaattttgaaactaaaaatgaactaaagacacactgcctgagagaagcaggctctctatccctgtattcctattctcacgaatataggtaaactaagtttccattaagcacagtatctaaagatgctgacacatctgctagtttaatctctttgaattgcctttcatgtatgacctaatgtttagaaaatgacaaggatcacacatgtagagtgacatccctgattaacagtgatgagcagaggcctcagacccaggggaagcagagaacatacatatttagtccatatcaccaaggcaacacagtgtacctcagcacagtagaaaaacaagcacagatgttgatgttgaatatttaaaaagtgttccttacacccactgtaacagtggttagacacaaagatgaattatttcaaaaaccaagctattaaaagtttttacttctctaatgtatgtatatgtgtgctttgtttttcattgctaatactccataggcagtcttggtcaaaaaacattctcttagcaacaaaaataaaggttcaaagtttgattctgacataaatgacttgt

SEQ ID NO: 437863 - DNA, 1666 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaacttttagctgtgtgttccctttacttctaatactgatttatgttctaagcctccccaagttccaatggatttgccttctcaaaatgtacaactaagcaactaaagaaaattaaagtgaaagttgaaaaata

SEQ ID NO: 437864 - DNA, 719 bp, Homo sapiens
cttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattattcgttgtcccataagttgagtaagcttatatacaccttttattaagagtttgtaaattctagcgtagtctacacagatttgtatatcaatttgtttatattgtttatgtaatgttatttctggaagtgtgaaaatgttaatgttcacaagcgacattaatataaatatacacgaattgatataaaaactgtgtagcaggatgaccaggggt

SEQ ID NO: 437865 - DNA, 1329 bp, Homo sapiens
cctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttagtctcactctatcacacaggctggagggcagtggcaggatctcagttcaccccaacctttgcctcacgggttcaagggattctcgtgcctcagccttccaagtagctgggattacaggtgtgcgccagtacgcctggctagttttagtattttttgttacagacggggtttcaccatgttggctgggctggtctcgaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctg

SEQ ID NO: 437866 - DNA, 528 bp, Homo sapiens
atagaggatccccaaacgcaggagaggatgatatattttaaaactgatttttctgcacgcaaataattgaacttgtctgaagatagtgtgcctgggaaaccagattttttttatttttatttttatttttatttttttgagatggagtcttgctctgtcaccaggctggagttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttt

SEQ ID NO: 437867 - DNA, 1204 bp, Homo sapiens
cctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaacaaatgaacaattgtgcggtatgcaaatgtagccaataatatactcaactggaaaatgaaatgaccagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttt

SEQ ID NO: 437868 - DNA, 1218 bp, Homo sapiens
ggactccaccctacctacccttcgcgtagtacttgttatactttggcagcttcttcacgtcggtcctctccgcgcgcgggtaggaaccgtccacggccttaaagaagcctcctcaccagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtaagtttatcatctgaattctccttattgtagacaacagaacaaaacaaaatattggtttttaaacaaatgaacaattgtgcggtatgcaaatgtagccaataatatactcaactggaaaatgaaatgaccagataatactggctgggtatggtggttcacaccttttatcccagcacttcgggaggctgaggcaggaggatcacttgagaccaggagtttgagaccagcctgggcaacatagcaagacctcatttctacaaacaaaaaaaaaattggcccggcatggtagtacttgcctataatcccagccacatgggaggctgaggtgggaggatcacttgagtctgggagagtttgaggttgcagtgagcagcctgggtgacagaatgagaccctgtctctaaaaataataataataatgatagtgtatatcttcatataatattttaagaggagcatatagatataacttctcccaactttttaattatagttttccaaacttacagagaagttaaaagaatggtacaatgaacatctatatatctttcaccacaatattaatcattgttaatattgtgtcacatttgctttctctctcctctctttgtatgtgtttctatataaaatattataacttttaaaatatatcttgttttgctaaaccatttgaaaataagttgcaaaaatcatgacacttcacccctagtttctttt

SEQ ID NO: 437869 - DNA, 1055 bp, Homo sapiens
tgtgatttcaaatgaaacgcttaaagtatcatttctttgcttatctcttcccttctttctcctcatcccagtgcttgatgtttcattacaattatttttctttatctctgtaactttcaataatatacttgtcttccatttattagtctttttaaaataactttttcttttttctttctttctttctttttttttttttttttgatacagagtctcactctatcacacaggctggagggcagtggcaggatctcagttcaccccaacctttgcctcacgggttcaagggattctcgtgcctcagccttccaagtagctgggattacaggtgtgcgccagtacgcctggctagttttagtattttttgttacagacggggtttcaccatgttggctgggctggtctcgaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctg

SEQ ID NO: 437870 - DNA, 879 bp, Homo sapiens
cccaggctccctggagtaaattcatagtctctctgtccaaagatgtcctgagccccataccagcacaccatctacttccaccctgtagtgctgtggttaggactaaattcccccagtcaccaaaaagtgttcatgactttcccaagcaaaacaaaaccccaaacaaaagataactctgttatatttcatggcttttaaccttttttagtatatgggttgctgtcatttctactttatgaattcatcaggagcatattataaagttcaaaaagttaggtgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctg

SEQ ID NO: 437871 - DNA, 733 bp, Homo sapiens
cctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttgtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaactctg

SEQ ID NO: 437872 - DNA, 951 bp, Homo sapiens
  misc_feature (16)..(16): n is a, c, g, or t
aatatatggctaggtngaggctgggttcgctccgtaaggcaagagaacccactaggggatgagcccgaactagggatgtgacagagcgcgagacccagcctaaagagagcccggagccagcgtgggaggccgctgccgtcgcgcgccttggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437873 - DNA, 1913 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttgcgctgcacgccagacaccggcctttcaatatccgtctcttccctgcaggttgacggcgttgcacgctctcgcggggaggctctggctttccaaacgctggcaccgagggtttttctgttcctttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437874 - DNA, 1751 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttgccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437875 - DNA, 708 bp, Homo sapiens
actactactaaatttgcgccccgtcgactggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437876 - DNA, 1322 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttcctttttttttttttttttaacttcctgcctatacacacgcagccatcagcccacaaagacatgactaccaacgcgggccccttgcacccatactggcctcagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437877 - DNA, 1351 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttgcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgtgacagagcaagactccgtctga

SEQ ID NO: 437878 - DNA, 457 bp, Homo sapiens
gttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgtgacagagcaagactccgtctgac

SEQ ID NO: 437879 - DNA, 1805 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttcctttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 437880 - DNA, 2030 bp, Homo sapiens
ctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttcctttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaaaaaaaaaaaaaaaaaaaaaaaaaaattggggggattataatgacggggtgcgggaaaacaagcgggtaactgaaagtgggcaacagggtcaataggctggtatccgtggacacaaagttttcttgggaacaaagggggtaagactttggccggagtatcccctaatatggggagcgacggaataaattccggataaggccagggttacccgtgggttaaatacga

SEQ ID NO: 437881 - DNA, 298 bp, Homo sapiens
ccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctctt

SEQ ID NO: 437882 - DNA, 729 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437883 - DNA, 1006 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaaaaaaacttctccagggctg

SEQ ID NO: 437884 - DNA, 639 bp, Homo sapiens
aatttcgatttcaggggcggggttcgattttacttactggcctcggctccaataccaaggtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437885 - DNA, 632 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437886 - DNA, 509 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagagtgttgtgaacattttcattattcttccttcaaacaaggtgggggccgcccggtttttttaaaagaatttgctgtaacctccctggaacaatacttttttttggccg

SEQ ID NO: 437887 - DNA, 913 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggcaagggctgggacggaggcttgtttgcgaggccgctcccacccgctcgtccccccgcgcacctttgctaggagcgggtcgcccgccaggcctcggggccgccctggtccagcgcccggtcccggcccgtgccgcccggtcggtgccttcgcccccagcggtgcggtgcccaagtgctgagtcaccgggcgggcccgggcgcggggcgtgggaccgaggccgccgcggggctgggcctgcgcgtggcgggagcgcggggagggattgccgcgggccggggaggggcgggggcgggcgtgctgccctctgtggtccttgggccgccgccgcgggtctgtcgtggtgcctggagcggctgtgctcgtcccttgcttggccgtgttctcgttcctgagggtcccgcggacaccgagtggcgcagtgccaggcccagcccggggatggcgactgcgcctgggcccgcctggtgtcttcgcatccctctccgctttccggcttcagcgctctaggtcagggagtcttcgcttttgtacagctctaaggctaggaatggtttttatatttttaaaaggctttggaaaacaaaaatacgcaacagagaccgtttgtgtgacactttgcagggaagtttgctggcctctgttctaggtcatgattgggctgcaagggcagagaag

SEQ ID NO: 437888 - DNA, 1108 bp, Homo sapiens
  misc_feature (985)..(985): n is a, c, g, or t
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaatanaaaaaaaaaaataaaactaaacataaaaattaaaaaaacattggccgcggtttacacgtgggaactggaaaaccttgctgtacccacttaatccgctggagcaaatccccttttgcacgtcgg

SEQ ID NO: 437889 - DNA, 1003 bp, Homo sapiens
gcacgacttagaggttgctcagacaactgctctcccggatgaggatgatgacctgtgagaacgaagctggagcccaggacagctgcctataaaactagacttctgacgctcccacgcgtcgcagcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437890 - DNA, 895 bp, Homo sapiens
  misc_feature (746)..(747): n is a, c, g, or t
  misc_feature (752)..(753): n is a, c, g, or t
  misc_feature (759)..(759): n is a, c, g, or t
  misc_feature (768)..(768): n is a, c, g, or t
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaaaataaaaaaaannttggnngcgggngcccggaangtttaaacacctgtggggcgggcccaggaggaaacgggcaagggcccaagaccggcgcaggggggtccacaaaaaagccgggcgggtggacaccaggggcgggtaggtcacaggccggacccccggg

SEQ ID NO: 437891 - DNA, 1122 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaacaaaaaaaaaaaaaaaaagaaaagaaaaaaaaaaaaaaaaaaagtcgagaactagtctctctcgtggctttaggaaaaccagcggaagctgaaggtctgggggtgggggcggaagttcgttacctttggtcgtcttttcacactaggttttggtttcaaggttcagttcggacgaaataggagcagtcccccatagttagtaagcttggcgggcccatgccattgaccgaggccatcacctgttgctctggggttgtcccggggaactgtcttttccatccttactgccacggtgtgcttggcatggcgcaaagggctctctgggaaggcctaagtgcgggatgagcacgggtgattgaatagttgccttgtaccagctgtgtgggggta

SEQ ID NO: 437892 - DNA, 1175 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaaaaaaaaaaaaaaaaaaaaaaaaaaaaaaagaaaaaaaaaaaaaacaaaaaaaaaaaaaaaaagaaaagaaaaaaagaaagaaaaaaaaaaaaaaaagggggggggggggggggaaaacatccccccggggaggaccgaaaaaaaaaatgccaacaccgataagtagaaaaaaaggggggacacaacaaaaggaggcgggcgataacaatcaaacacacgcagacgcggagcagggacaacaaaaaaaaacaaacacgacggcaggcagaacgcccagcagccagctaatagaagacacaacaagagagaaagcacacaacaataaggggggaggtagagaacaacaaagaggaaacaccaagaacacccacacagcagaagaatgaacacagcacaaagaagcagcaaacaacacaaaaacgacatcgagtgcatagaacg

SEQ ID NO: 437893 - DNA, 949 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtattgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437894 - DNA, 775 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatttggctggcgacacgccagccaacaggatgtgactccagccagccaaatccatcctggtcttccatttcttccacgatg

SEQ ID NO: 437895 - DNA, 1081 bp, Homo sapiens
tacaactaaagcagcaaatcaaaacatctgctgaggttttctggtagaacaacaacaaaattagttggtgcccatgttcagtaagtcactaccattgacaaaactaaatccaaaataggaaattgaaaagtgcataatgaaattaaatcttgtatcaagtatttgtggaaaactggaaatgtttctctggtatggttggtgaatgatgatttggaggaggtattaaagtttatccgatccagctttggcctggtgttccacgtagaaaaggataggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437896 - DNA, 780 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgtcaatcataatgttgggggacgccgaccgatcggggtcgcgtaagctagttagcatcgaccaagagtctcgttcgttatctggaatgaaccacgacaaaatcgctccacg

SEQ ID NO: 437897 - DNA, 885 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437898 - DNA, 1727 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggtaacaagatgcttaactcttgtaataatggcgatagctttctggagttcatatggtatactacttgtaaatatgtgctaagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgtgcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437899 - DNA, 952 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437900 - DNA, 1868 bp, Homo sapiens
tggtggtgggcgcctgtagtcccagctactcaggaggctgaggctggagtgcagtggtgcgatctcagctcactgcaacctctgcctcccaggttcaagcgattctcctgcctcagcctactaagtagctgggactataggtgcgcaccaccacgcctagctaatttttgtattttttcagtagagacagggttttgctatgctggccaggctggtctcaaactcctgacctcagatgatccagccacctcagcttcccaaagtgctggggttccaggtgttagccaccatgcctggccatagacttgtttctgttcccttctcactgtggctgtaccaaggtgttgcttatcccagaagtcgtgatgcaggtcagcactttctccatgggaagttttagcagtgtttctttttagaatgtatttgggaactttaattcataatttagcttttttttcttcttcttataaataggctgtaccagtgcaggtcctcactttaatcctctatccagaaaacacggtgggccaaaggatgaagagaggtaacaagatgcttaactcttgtaataatggcgatagctttctggagttcatatggtatactacttgtaaatatgtgctaagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgtgcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437901 - DNA, 928 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtgacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437902 - DNA, 623 bp, Homo sapiens
caccccaaccaccaccgccacaacccacaaactacggctaggtacgaggctgggtgtggcagcgtctggggtttccgttgcagtcctcggaaccaggacctcggcgtggcctagcgagttatggcgacgagaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437903 - DNA, 955 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtgccatgaaaaagcagatgacttgagcaaagaaaaaaaaagaaaaacaaaaaaaaaaaaaaaaagaaaagaaaaaaaaaaaaaaaaaaagtcgagaactagtctctctcgtggctttaggaaaaccagcggaagctgaaggtctgggggtgggggcggaagttcgttacctttggtcgtcttttcacactaggttttggtttcaaggttcagttcggacgaaataggagcagtcccccatagttagtaagcttggcgggcccatgccattgaccgaggccatcacctgttgctctggggttgtcccggggaactgtcttttccatccttactgccacggtgtgcttggcatggcgcaaagggctctctgggaaggcctaagtgcgggatgagcacgggtgattgaatagttgccttgtaccagctgtgtgggggta

SEQ ID NO: 437904 - DNA, 575 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtgccatgaaaaagcagatgacttgggccacattatggaggcgccgtcgcctacgca

SEQ ID NO: 437905 - DNA, 1474 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggtaacaagatgcttaactcttgtaataatggcgatagctttctggagttcatatggtatactacttgtaaatatgtgctaagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgtgcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437906 - DNA, 1839 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggtaacaagatgcttaactcttgtaataatggcgatagctttctggagttcatatggtatactacttgtaaatatgtgctaagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgtgcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaaaaaaaaaaaaaaagtcgagaactagtctctctcgtggctttaggaaaaccagcggaagctgaaggtctgggggtgggggcggaagttcgttacctttggtcgtcttttcacactaggttttggtttcaaggttcagttcggacgaaataggagcagtcccccatagttagtaagcttggcgggcccatgccattgaccgaggccatcacctgttgctctggggttgtcccggggaactgtcttttccatccttactgccacggtgtgcttggcatggcgcaaagggctctctgggaaggcctaagtgcgggatgagcacgggtgattgaatagttgccttgtaccagctgtgtgggggta

SEQ ID NO: 437907 - DNA, 900 bp, Homo sapiens
ctctctctctctctctctctctctctctctctctctctctctctctcgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtgccatgaaaaagcagatgacttgagcaaagaaaaaaaaagaaaaacaaaaaaaaaaaaaaaaagaaaagaaaaaaaaaaaaaaaaaaagtcgagaactagtctctctcgtggctttaggaaaaccagcggaagctgaaggtctgggggtgggggcggaagttcgttacctttggtcgtcttttcacactaggttttggtttcaaggttcagttcggacgaaataggagcagtcccccatagttagtaagcttggcgggcccatgccattgaccgaggccatcacctgttgctctggggttgtcccggggaactgtcttttccatccttactgccacggtgtgcttggcatggcgcaaagggctctctgggaaggcctaagtgcgggatgagcacgggtgattgaatagttgccttgtaccagctgtgtgggggta

SEQ ID NO: 437908 - DNA, 887 bp, Homo sapiens
cttttgaggacacaggcctagagcagttaagcagcttgctggaggttcactggctagaaagtggtcagcctgggatttggacacagatttttccactcccaagtctggctgctttttacttcactgtgaggggtaaaggtaaatcagctgttttctttgttcagaaactctctccaactttgcacttttcttaaagaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtgacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437909 - DNA, 1296 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggtaacaagatgcttaactcttgtaataatggcgatagctttctggagttcatatggtatactacttgtaaatatgtgctaagataattccgtgtttcccccacctttgcttttgaacttgctgactcatctaaacccctgctcccaaatgctggaatgcttttacttcctgggcttaaaggaattgacaaatggggacacttaaaacgatttggttttgtagcatttattgaatatagaactaatacaagtgccaaaggggaactaatacaggaaatgtcatgaacagtactgtcaaccactagcaaaatcaatcatcattgtgaaacataggaagcttctgtagataaaaaaaaaaattgatactgaaaactagtcgagactccatttatatgtgtatgttttctgaaagcctttcagaaaaatattaaatttaaggacaagatttttatatcagaggccttgggacatagctttgttagctatgccagtaattaacaggcataactcagtaactgagagtttaccctttggtacttctgaaatcaggtgcagccccatctttcttcccagagcattagtgtgtagacgtgaagccttgtttgaagagctgtatttagaatgcctagctacttgtttgcaaatttgtgtctactcagtcaagttttaatttagctcatgaactaccttgatgtttagtggcatcagccctaatccatctgatgctttttcattattaggcatgtgcatgttggagacttgggcaatgtgactgctgacaaagatggtgtggccgatgtgtctattgaagattctgtgatctcactctcaggagaccattgcatcattggccgcacactggtggtaagttttcataaaaggatatgcataaaa

SEQ ID NO: 437910 - DNA, 590 bp, Homo sapiens
tgatgtgatcccatttgtccatttttgctttgattgcttgtgcttttggggtattactcaagaaatctttgccaagatcaatgtcttggagggtttccccaaggttttctttcattagtttcatagtttgaggtctcagatgtaagtctttaatctattttgatttgatttttatatatggcaacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437911 - DNA, 419 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggtatcagagcttacactcagtctacttatcttttcgaaacggtggcaaggtaggagatttggacttgattactctacagtgttgct

SEQ ID NO: 437912 - DNA, 291 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaagtaatggaccagtgaagtgccgatgatagcgagtactcgatgatacggtaccgacc

SEQ ID NO: 437913 - DNA, 685 bp, Homo sapiens
caccccaaccaccaccgccacaacccacaaactacggctaggtacgaggctgggtgtggcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaag

SEQ ID NO: 437914 - DNA, 938 bp, Homo sapiens
caccccaaccaccaccgccacaacccacaaactacggctaggtacgaggctgggtgtggcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437915 - DNA, 1070 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaacaaaaaaaacacaacaaaaaaccttttttggggcggccctgggaccccgagaaaaaggtttttaaagaaacccatctgtcgggtgtgtgacgccgcccgccccccaagtaggggctcgcttgggaaccacggggccccgaggccatggtccccccaaggaaaaaacgcgtgcgcacagtcaaacaagtggcttgggattctctccccgaataaaaaaagacgcccgggggggaacgaccagatggcgtttggaaacaatcccccggatggaagctcgggaggccacagacaggggcactctccaaagagggtccacacggaacgcaatataatagc

SEQ ID NO: 437916 - DNA, 964 bp, Homo sapiens
caccccaaccaccaccgccacaacccacaaactacggctaggtacgaggctgggtgtggcagcgtctggggtttccgttgcagtcctcggaaccaggacctcggcgtggcctagcgagttatggcgacgagaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaacaaaaaaaacacaacaaaaaaccttttttggggcggccctgggaccccgagaaaaaggtttttaaagaaacccatctgtcgggtgtgtgacgccgcccgccccccaagtaggggctcgcttgggaaccacggggccccgaggccatggtccccccaaggaaaaaacgcgtgcgcacagtcaaacaagtggcttgggattctctccccgaataaaaaaagacgcccgggggggaacgaccagatggcgtttggaaacaatcccccggatggaagctcgggaggccacagacaggggcactctccaaagagggtccacacggaacgcaatataatagc

SEQ ID NO: 437917 - DNA, 784 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagatacttaacaaaaaaaaaacaagacaggaggaaaaaagaaaggaggaggaaaaag

SEQ ID NO: 437918 - DNA, 890 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagaaaaacaccacccacaaataaacaaaagaaaaaaaaaaccgggggttttttgggggggggggaaaaaggggttataaagggccgggtcaggtttccggcccctttttttttccaccaggggaaaaccgggggccccagggggggtaaattaacgggtacta

SEQ ID NO: 437919 - DNA, 927 bp, Homo sapiens
ctctctctctctctctctctctctctctctctctctctctctctctcgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437920 - DNA, 1076 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaaaaaaacaaacaacaaaacaacaacataggtacacaaacaacaacatacaaacaaagcaaaaaagaacagaacagcaacaacactataacacagc

SEQ ID NO: 437921 - DNA, 1018 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccgttgggctttttggggttaaagatccattcttaaaaaaaaaagggggggggaaaattcttcggggtatggccacttttaaaggcgtt

SEQ ID NO: 437922 - DNA, 982 bp, Homo sapiens
gcgtgcgaggcgattggtttggggccagagtgggcgaggcgcggaggtctggcctataaagtagtcgcggagacggggtgctggtttgcgtcgtagtctcctgcagcgtctggggtttccgttgcagtcctcggaaccaggacctcggcgtggcctagcgagttatggcgacgaaggccgtgtgcgtgctgaagggcgacggcccagtgcagggcatcatcaatttcgagcagaaggaaagtaatggaccagtgaaggtgtggggaagcattaaaggactgactgaaggcctgcatggattccatgttcatgagtttggagataatacagcaggctgtaccagtgcaggtcctcactttaatcctctatccagaaaacacggtgggccaaaggatgaagagaggcatgttggagacttgggcaatgtgactgctgacaaagatggtgtggccgatgtgtctattgaagattctgtgatctcactctcaggagaccattgcatcattggccgcacactggtggtccatgaaaaagcagatgacttgggcaaaggtggaaatgaagaaagtacaaagacaggaaacgctggaagtcgtttggcttgtggtgtaattgggatcgcccaataaacattcccttggatgtagtctgaggccccttaactcatctgttatcctgctagctgtagaaatgtatcctgataaacattaaacactgtaatcttaaaagtgtaattgtgtgactttttcagagttgctttaaagtacctgtagtgagaaactgatttatgatcacttggaagatttgtatagttttataaaactcagttaaaatgtctgtttcaatgacctgtattttgccagacttaaatcacagatgggtattaaacttgtcagaatttctttgtcattcaagcctgtgaataaaaaccctgtatggcacttattatgaggctattaaaagaatccaaattcaaactaaa

SEQ ID NO: 437923 - DNA, 3223 bp, Homo sapiens
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctgagaatttgtaa

SEQ ID NO: 437924 - DNA, 1713 bp, Homo sapiens
  misc_feature (804)..(804): n is a, c, g, or t
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggtgcgcgcccctgctcccctgggtggccttccgggagcccagtctaactcgattcttcccaggggctctttttggacggtcccaaaggaggcagcgggagggaggtgaaagatactttgataaccgtcgacccataagtatacttgttatgcacctaccacgagttttagagaagaacatactttttggcagggaagtgaatcccctataagaatataggggaggggaaagccacactttaaagagaatttgggtagggtttgatattgtagatttgtgatgcttttcttcttgaactgcttaactaatttaccctcaaatttttttgatccggaacttgccgtctggtttttctcagacttcttaattctgacttatcatgaagtatctaggaacttcattctcaagtttnagtgcttgtaaaaagttgcctggttatattatgccattggcagtacatcatcttcacaaggattacgtaagtgaactacatctcattcctgtttccaactagtgaagaacgattgtgaaatgggattttagaaaatggctgttctctgtgattgggcatagaaggtttgtaagttttagagactgcagctgttgaatcctttctgctaagagagcgatgacaggcaatagaaaagggatagtgtttgacatctaaaatgacatattttcacattttatgaggtgttatatccccagcaccaaaaatagtgcctttcacacagtaggagctcagtaagtattttttgaggaaattattggggaatgaatggatggtagaaaacccaagcttctgttacttggataccggcatataaaggagaggacaggaagacaaacatttctggaaatggcttttatccaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacacactcatgtgcggaggaaggttgggacagatgcccgcgtggactccgtagcaacgggaacgagccgggcccagggaaacagtcctgatgggaccctgaaaaaaggtaggccctaccgggggcggaaaccccccccgatggagaacacccacggggcccaacaataccggagccaccggccccg

SEQ ID NO: 437925 - DNA, 4097 bp, Homo sapiens
  misc_feature (804)..(804): n is a, c, g, or t
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggtgcgcgcccctgctcccctgggtggccttccgggagcccagtctaactcgattcttcccaggggctctttttggacggtcccaaaggaggcagcgggagggaggtgaaagatactttgataaccgtcgacccataagtatacttgttatgcacctaccacgagttttagagaagaacatactttttggcagggaagtgaatcccctataagaatataggggaggggaaagccacactttaaagagaatttgggtagggtttgatattgtagatttgtgatgcttttcttcttgaactgcttaactaatttaccctcaaatttttttgatccggaacttgccgtctggtttttctcagacttcttaattctgacttatcatgaagtatctaggaacttcattctcaagtttnagtgcttgtaaaaagttgcctggttatattatgccattggcagtacatcatcttcacaaggattacgtaagtgaactacatctcattcctgtttccaactagtgaagaacgattgtgaaatgggattttagaaaatggctgttctctgtgattgggcatagaaggtttgtaagttttagagactgcagctgttgaatcctttctgctaagagagcgatgacaggcaatagaaaagggatagtgtttgacatctaaaatgacatattttcacattttatgaggtgttatatccccagcaccaaaaatagtgcctttcacacagtaggagctcagtaagtattttttgaggaaattattggggaatgaatggatggtagaaaacccaagcttctgttacttggataccggcatataaaggagaggacaggaagacaaacatttctggaaatggcttttatccaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgttatttttctatatctgaaataaatgcttctaccatagaaataaatttgcctatactatctgagaatttgtaa

SEQ ID NO: 437926 - DNA, 3582 bp, Homo sapiens
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccacggaaacaagactgcagaagtttctgggcactcagtcgggactctcatttaatacccagagagaggagatcttccaggttgccccgactcccaccgggactcctaccagcagcaacctcatcattgtggccgaggcaggaattatccagactgccttgccactagatgaatggaagacaatgatttgaactaagggccagcaaagaattatccctggtttttgtgctttgcagcattcctcaaattgttttcacatctcttaccataaaaactgcattgaaattgaaaatgaagcagttgaaaagaaaaaggaaaagcaattttagtgttcaagaaactcagacccttttgaaagaaattacgaaaaggaaagaagtcattttttccaagcagctcaatacaacaattaatgtgatgaagcgaatggcttgggaagagattgcacagtgtgtgaatgctgtaggagaaggagaacagaggacagggacagaggtgaaaagaaggtaccttgactggcgagcacttatgaagagaaagaggatgaaggccaacattaagctggttggttcaggatttccccttccctcctctgatttggatgactctctcactgaagagatagatgaaaagattggattccgaaatgatgcaaattttgactggcaaaatgtggcagatttcagggatgcaggtggatccttaactgaggtcaaggtggaagaggaagaaagggatccgcagagtcctgaatttgaaattgaggaggaggaagaaatgttgtcatccgtcataccagattccaggagagaaaatgaacttcccgatttcccccacattgatgagttttttacccttaactcaacaccatctagatctgcatatgatgagcctcatttgctcgtaaatattgagaaacagaaactagagttggaaaaacgacgactggatatcgaggccgaaaggctgcaggtagaaaaggaacgcctacaaatcgagaaagagaggctgcggcatttagacatggaacatgagcggcttcagctagagaaggagcggctgcagattgaaagagaaaagttgaggttacagatagtcaattcagagaaaccgtccttggaaaatgaacttggtcaaggagaaaaatccatgcttcaaccacaggacatagaaacagagaagttaaaacttgagcgagaacgcttgcaactggaaaaggataggctgcagtttttgaagtttgaatctgagaagctgcagattgaaaaggaacgcttacaggtagagaaagacagacttcgaattcagaaagaaggacacttgcagtgatttttccaggcttccatttagcaaatgtttgaaaactctagatttttctcatatcaggtgatataatgatggttgctggattagctgtggtttcttgtctaatgtcagtgttcagtaggaaaaagttatatgtggataactgtatgcctaagtagtatataaaagctgtgccctagcgtaaacagtatagcagaaacttactgtgctggactctttaccttataatattacatagagtcttgtattgtctgtgtacccagagtttacaattatgtccatataaaattctagcccagaagttctcatctggggtagattttggccttcagaagaccaatttggtgatgtctggagacatgttgggttgtcaaaactggggtggggaaaaggttgctactgtgcaatgcatacctcctcaacacccccccacactcagtaaagaattttccaacccaaaatatcattagtcctgaggttgagaaaccctgtcctagcctaactgtgtacctctatagctatgttttatagttttagaatattaaaacctcagatatttatgtgggtaggtacttaaatggccaaaaactttaactatgaaatgttactgtgtagtatattgaatataggaagtgatgaagattataggtattttattcccatgtttccatctataaatagccttctcagattcagaaaacaatacagagaacatcagaaattttctaaaatgggtcactttgaaaagaattctttttctcactattaatgctttagaagcaagacgcaattttaaagctttagttccttttctttcagtcattgtcttagtttgggtacaaaaatgtcatttcagtaatgtactgaaatcttataagtgaatagttgaagctagtaaaaatgataccagtataaaaatggtacttgtagtccatgagcttgaacccaatgactgattgtttgacttttaaaataagtaatagcagccatttgggagtagggggtaggtggggaagatgtactccgtatcaaataataatgatgttgaaataatgatagtaggtatgtattatggattggagaagcacttattacactatctaacctaatatgtagaacaattcttgagagttgtatctgtcgttatttctgaatgtgaagctcagagaagtgacacagagtaaatggctgatcttctatattgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgttttctgattttcaaggttgatacatagctttaatacagctcttctgttgacagttattactttaattttgcatttgttccttgtaagaatggctggaaactgtgtgttgacatttgaggatgggtatgcaaggaaaaaatatacttctgtttacttactctgactttgaaatagtgtagtatattttgtccttccctcttccctgaggaacaaagcacgtatctttagtctctttgatatttattctgagaccaagggcttgcttgacctgatgattttccttcagctctctgaaggtgctttttccacaatccaagtgattctgatacacactaaagttgagaatcactgcactagatcactttgtgtcttctgattttcaaggttgatacatagctttaatgcagctcttctgttgacagttattactttaatttttgcacagtttccgccgcgcggtgaggtcgtctagtccacagctccggaagccatgccgtccaagggcccgatgcagtccgtcgcaggacttacggacgcaagacgacaggaccagctgtggcgcactgccaacgcggcaatggctcatcaaggtagaacgggcggccctg

SEQ ID NO: 437927 - DNA, 1516 bp, Homo sapiens
cctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagcta

SEQ ID NO: 437928 - DNA, 2328 bp, Homo sapiens
cctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagca

SEQ ID NO: 437929 - DNA, 2177 bp, Homo sapiens
cctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattgcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagca

SEQ ID NO: 437930 - DNA, 1922 bp, Homo sapiens
cctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggatttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagca

SEQ ID NO: 437931 - DNA, 583 bp, Homo sapiens
ctctagattctggtatcaaatgatgcctgatttaccagcagtttagatatttgctagaaattgcttatctcatgcttcctagctcccagaggctgtgtttctaggacacgtccaatctggaggccacagatatgaccaagtagaaagagtataatcagtgctacgtataggaacaaaatgttttgtcttcattttgcccctcccaccaagtcagtgtgtaaacttgggcaactccctttttctctctgggccttatttctatcagagtttacagttgagggtcttgactgatagtaactattgttatgaaggctacagtttatagagcacttacatgctgggcactttacatgtatgattctgtttaattctcgtgatcacccagtgagaagtcctattttgacccccgttttgcagacaaggctcagagagagtaaatggcttatatgaggtcaccatgctagtgagtggtgaggaaccttttgctacctggcaggaccaggttagggcaggggtgggccctcggcaactctgagaattctttctggcacagaggacatacggatcgatgagaggacagtca

SEQ ID NO: 437932 - DNA, 802 bp, Homo sapiens
ctgggctgcggaagagggacagaaggaaatccatagcgctctcttgctggactggggaagaggagcgggcccaccagagcatcctgacacagcgggtgcactgggccgaggcgctgcagaaacttgacaccatccgcactggcctggtgggcatgcttactcacctggatgacctccagctgattagtcaggcaagggtgagggcatgaccagttggccaggctccccaaaagcctgaaaatatcgagaatgtttgtcggtatgaggagggtggaaatgagaatttggagcagggatgagtgacaaagattctttgcttggccaaactttagtcaggcttctgagccttctcccaggcccatctgtgcacttcattataaaatccagtttttgcaaaataaccctgctaagtcagtgtagccagaaacccccatccttgatatctgatcatccttgatatctgatccggttcctcatccaccaccatcccctaggtgatgtctgatcactgtgttctgtctgcagcaagaatcctgttaggtaggtttagccataatcccccttacccccaatgtttcctcttagtaattttccatccactaacccccaaccctgctccttagctataaattcctacctgcccacgctgtattcagagttgaacccagtctctctcccattgcaagaccccattgcaatgaggtcttgaataaagtctgccttactgtgctctaacaggtatcattgaataatttcttctctgacatgaggcaagggaataaaactatgattctttggcact

SEQ ID NO: 437933 - DNA, 1767 bp, Homo sapiens
  misc_feature (69)..(69): n is a, c, g, or t
aaacccgcgggaataacctggacccctttcaaaggcaaaatttcaagccaaaacagggcattgatcccnggtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgagggagttaagagggccaaccttagggcacgtgggcattattaaaggtcttaaaagca

SEQ ID NO: 437934 - DNA, 2345 bp, Homo sapiens
cctgcgacaggtggagcgcacggggcgggcgcacggccatgtccgccgagggcgcggagccggggccggggtccgggtccgggcccgggccggggccactctgccccgaacacggccaggctctgagctggttctgcggctccgagcgacggcccgtgtgcgccgcctgcgcggggttgggcggtcgctgccgggggcaccgcatccgccgggcggaggagcgcgccgaggagctgcggaacaagattgtggaccagtgtgagaggctgcagttacagagtgctgccatcaccaagtatgtggcggacgtcctgccggggaagaatcaaagagcagtgagcatggccagtgcagcgagggaactggttatccagcggttgagtctggtgaggagtctttgcgagagcgaggagcagcggttactggaacaggtgcatggcgaagaggagcgggcccaccagagcatcctgacacagcgggtgcactgggccgaggcgctgcagaaacttgacaccatccgcactggcctggtgggcatgcttactcacctggatgacctccagctgattcagaaggagcaagagattttcgagaggaccgaagaagcagagggcattttggatccccaggagtcggaaatgttaaactttaatgagaagtgcactcggagcccactactgacccaactctgggcaacggcggttcttgggtctctctcaggcacagaggacatacggatcgatgagaggacagtcagccccttcctgcaattgtcagatgatcgaaagaccctgaccttcagcaccaagaagtcaaaggcctgtgcagatggcccggagcgcttcgaccactggcccaatgccctggctgccacctccttccagaatgggctccatgcctggatggtgaatgtccagaacagttgtgcctataaggtgggcgtggcttcaggccacctgccccgcaagggttctggcagtgactgccgtctgggccacaatgccttctcctgggtcttctctcgctatgatcaggagtttcgtttctcacacaatgggcagcacgagcccctggggctgctgcggggcccagcccagctgggtgtagtgctggacttgcaggttcaggagctgctcttctatgagccagcctccggcacagtgctctgtgcccatcatgtgtccttcccggggcccctcttcccagtctttgctgtggccgatcagaccatttctatcgtccgctgacctctggccacaggaagccaggtccaccgcccaccaccctttcaggccatgtttctactcagtgtgcttttcccaaatgatgtgtgtggtgtttctaagagaaacagggcccataaccagtgggcagctttaggagggatggggatctgtttcagatctaggcataacctgtaaatcacaggtgtccaaacttttggcttccctgggccacatttgaagaagaattttcttgggccacataaaatacactaacgatagctgatgagctaaaaaaaaaaaaaaaagtctgtgtataatttttgtgatatctgccaccacagataagcaaaaaagtccttgcattcaaagggttggagattgctgctttgagtgctgggtacctgtggggaacctactactccctgggccttagtctcccaaatccaccatgcatctgcccctctgagggtgtcttcactttgtctctggcatctagcatggtgcctggtgcatagtgagcatgcaataaatatttggcaggtgagtggatggatagatggataggtgaatgtaggtggacaggtgactgggtggatgttgtggtctctggagaagcactgccattcagcctcctgctccagctgttcacatgcagaaatgctctcttcacaggcagagaagcctgtggctaaagtttccacatcccattaactcagtgcttttgtctttttcatgacatggcacatagagaaaatatttttttctagcacacaagagcaacctgaaaggctgctcctggccagaggactctgtcccgggggaccgtgtcctcccccatgtcctgcctaggccctcagaggaccaggggatcatgtctccaggtaacccgactgtagcccctgctggctgagctccagcctgtgcccactgataatagcagggacggccttttctcttagagcagctgataagtttccctacctgatggccccctctgacataaactgcacacctggggtgatggcttaaagccagaaagagctgaggtacctcataagggcttgccttagcggaacgttcgcgccctctctgacgggctgatgggaacccgccataaga

SEQ ID NO: 437935 - DNA, 1802 bp, Homo sapiens
gtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437936 - DNA, 1983 bp, Homo sapiens
gtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtgaggagccctgtctttccccagccactgagaaaccaaagatcacctagatttccatcagaagtgggctttgcccaaacccaaaataccaccccaacccagaatccattttggaaagcccctacctccagtcctcatctgaggcgctctggctctaagcctgtcctccctcccattccaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437937 - DNA, 2957 bp, Homo sapiens
gtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggtaataggagagacatgtttgagatgagatgaaggggtacaaagttagggccctctcactggtcttggttcagcctaggcttcagttcccttgactgaccactcagggcttcccttctcctaccccaggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacaggtgtgagggtcaggagagaagcagaactgatgggatgggtccgtgggtcagtccttgttgcctgctagcttctaagcctcagcatcctaggagctgaccacagactgatcattagggctggaaatcatgggtgtaaattgcagtttcttagtaaacaactggccctgctcttcttaagaaaaatatagggctgggcacagtgactcacatctgtaatcccagcactttgggaggtgaggatgggaggatcacttgagcccaggagtttgagaccaccttgaataacatagggaaatctcatctctacaacaaattaaacatttagctgggcatggtggcacatgcctgtagtcctaccttcttgggaggctgaggtaataggatcacttgagcctgggaagaaagtggatgttgcagtgaaccatgatcacaccactgcacactgcactccagcctgctgggcgacagaacaaggccctgtcacaaaaaaaaaaaaaggaaaaatgtagtttaccccatgactttctagaagttagaacagtagagcgattttgagaataagccccggattcatactgctggaagttaaatcacctcctaggccagcatctctcagtctttcatgtgtatccagattacctgtagatcttcagatgcaaactgtgattcagtaggtctagagttgggcccgagagtctgcatttcacaagctcacaggggatgtgtatgctgctaccgcactttgagaggtgacagcctatgatcactaacaagttacttaacctctctaagcctcagtttcctcagccataaaatagaggtaatataattacctgtgtcataggattcattgtattaggtaaggggattggtgcaaaacacttagtatactgagtgcttagcacattgtgtttaataaatattaggtatcgtcattaggatttttcttatctcttaattctctgaagtttaaagtctaagccctttatcctggatgccttctaaccttaaccacttgcttctacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437938 - DNA, 1587 bp, Homo sapiens
ggctgctgtttctaaaacccctttccctctaacccacaccacctttctactcactgatgccttcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437939 - DNA, 2829 bp, Homo sapiens
gtagggccccagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacaggtgtgagggtcaggagagaagcagaactgatgggatgggtccgtgggtcagtccttgttgcctgctagcttctaagcctcagcatcctaggagctgaccacagactgatcattagggctggaaatcatgggtgtaaattgcagtttcttagtaaacaactggccctgctcttcttaagaaaaatatagggctgggcacagtgactcacatctgtaatcccagcactttgggaggtgaggatgggaggatcacttgagcccaggagtttgagaccaccttgaataacatagggaaatctcatctctacaacaaattaaacatttagctgggcatggtggcacatgcctgtagtcctaccttcttgggaggctgaggtaataggatcacttgagcctgggaagaaagtggatgttgcagtgaaccatgatcacaccactgcacactgcactccagcctgctgggcgacagaacaaggccctgtcacaaaaaaaaaaaaaggaaaaatgtagtttaccccatgactttctagaagttagaacagtagagcgattttgagaataagccccggattcatactgctggaagttaaatcacctcctaggccagcatctctcagtctttcatgtgtatccagattacctgtagatcttcagatgcaaactgtgattcagtaggtctagagttgggcccgagagtctgcatttcacaagctcacaggggatgtgtatgctgctaccgcactttgagaggtgacagcctatgatcactaacaagttacttaacctctctaagcctcagtttcctcagccataaaatagaggtaatataattacctgtgtcataggattcattgtattaggtaaggggattggtgcaaaacacttagtatactgagtgcttagcacattgtgtttaataaatattaggtatcgtcattaggatttttcttatctcttaattctctgaagtttaaagtctaagccctttatcctggatgccttctaaccttaaccacttgcttctacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437940 - DNA, 360 bp, Homo sapiens
gtcgacgggggacaaagaagctggggtgatagaccaggacacagggataccccatggtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaaaaaaaaaagcaacacgaaaactagaagaaccagcagacagccaacaaccacaaacgtgggg

SEQ ID NO: 437941 - DNA, 614 bp, Homo sapiens
ggccgggctgaaccatggcgggcggcggcatgggggcggtggggctccgcgggcagcctggttgcgctgcacccggacggggccgaggggacctgaaagctgcggcagagcctgaccgcgccgttctccagaagagccccggccgcggctgagtcgcgctccgggtgtggacggagccggagcctccccggggctcggtgaggacacagggcccaagccccgggccttcaagtcttgaccgagcgcatccccggcccttctgcgcccacacctgagtttttgtctgtaggagtttccgcagtttgctaagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataacccttta

SEQ ID NO: 437942 - DNA, 455 bp, Homo sapiens
catgttgagctgcaccttgtccccttccgccccagctaactcggtgaccagtggaggccacacccacgtgacacctgctgtccttgacagcagctccgacggcacctctgtggctctgcaggagccgcctccccgcctcgtgggcacacagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataacccttta

SEQ ID NO: 437943 - DNA, 1816 bp, Homo sapiens
catgttgagctgcaccttgtccccttccgccccagctaactcggtgaccagtggaggccacacccacgtgacacctgctgtccttgacagcagctccgacggcacctctgtggctctgcaggagccgcctccccgcctcgtgggcacacagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatggtgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcagtctagcctgggcaacaagaatgaaactctgtctcaaaaaaataaaaataaaataaaataaactccatcttaaaaccagtgaaaccaccattgcaaaattataactgagacagtgagagatctgacctaaccaactccatcctacttttaacctccaaactgtccttgttcattcctgggtgtaggccaaactaactttggaagaaacttagtttatggtttcccgaaacaaatccttttcttgtctggagactagactgcctttgtaggactaacaaattagccacaagattagaaattatggtttagaattcatgcagctggagattacaagattctgaccctccctaaattgctcctggggataacatcactattgaaaaacctaacaacagtgcttgagatattttgcagaccttgcacttgctgaatcagctgggaccatccagatggataaactggctcatctgatcttgtggcccgcacccagcaaccggctcaggccaagaggacagctttgatccatacgatttcatctctgatctgacccctcagtgctcccagcttactggccccctacctaccaaattatccttaaaaactctgaactccagggctgggcacggtggctcacacctgtaatcccaggactctgggaggccgaggcaggcggatcacttgaggtcagaagttcaagaccagcctggccaacatggcaaaaccccgtctctactaaaaatacaaaaattagccaggcgtggtggtgcacgcctgtaatgccaactacttgggagcctgaggcaggagaattccttgaaccctgaaggcggaggttgcagtgtgctgaaatcgcaccactgcactccagcctgggcaacagagcaagactccatctcaaaaacaacagcaaaaactctgaactccgaattcttggggaaattgatttgagtaataataaaactctggtctcccgca

SEQ ID NO: 437944 - DNA, 514 bp, Homo sapiens
agtcagagtagagacagaagaaaaattgatcagcacacattactccaaagcattgtaaacagaactgacttagatccacgtgtcctgtccaactctggttggggacagactcctattaagcagaatactgcctgggatacagaaacatcacctagaggggaacgaaagactgacaatgggacagaggcctggggaagctctgcaacacagaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataacccttta

SEQ ID NO: 437945 - DNA, 1955 bp, Homo sapiens
catgttgagctgcaccttgtccccttccgccccagctaactcggtgaccagtggaggccacacccacgtgacacctgctgtccttgacagcagctccgacggcacctctgtggctctgcaggagccgcctccccgcctcgtgggcacacaggtgagctgaccgtacttgcccagccggtctgagggaagcgaggtcaggggcgacggcgccgcctccgcctccgcctccgcctgtcccctccctccgtccggcatccgcgccgctcaaggactccaaagtcagcgtcgcgaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatggtgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcagtctagcctgggcaacaagaatgaaactctgtctcaaaaaaataaaaataaaataaaataaactccatcttaaaaccagtgaaaccaccattgcaaaattataactgagacagtgagagatctgacctaaccaactccatcctacttttaacctccaaactgtccttgttcattcctgggtgtaggccaaactaactttggaagaaacttagtttatggtttcccgaaacaaatccttttcttgtctggagactagactgcctttgtaggactaacaaattagccacaagattagaaattatggtttagaattcatgcagctggagattacaagattctgaccctccctaaattgctcctggggataacatcactattgaaaaacctaacaacagtgcttgagatattttgcagaccttgcacttgctgaatcagctgggaccatccagatggataaactggctcatctgatcttgtggcccgcacccagcaaccggctcaggccaagaggacagctttgatccatacgatttcatctctgatctgacccctcagtgctcccagcttactggccccctacctaccaaattatccttaaaaactctgaactccagggctgggcacggtggctcacacctgtaatcccaggactctgggaggccgaggcaggcggatcacttgaggtcagaagttcaagaccagcctggccaacatggcaaaaccccgtctctactaaaaatacaaaaattagccaggcgtggtggtgcacgcctgtaatgccaactacttgggagcctgaggcaggagaattccttgaaccctgaaggcggaggttgcagtgtgctgaaatcgcaccactgcactccagcctgggcaacagagcaagactccatctcaaaaacaacagcaaaaactctgaactccgaattcttggggaaattgatttgagtaataataaaactctggtctcccgca

SEQ ID NO: 437946 - DNA, 1922 bp, Homo sapiens
catgttgagctgcaccttgtccccttccgccccagctaactcggtgaccagtggaggccacacccacgtgacacctgctgtccttgacagcagctccgacggcacctctgtggctctgcaggagccgcctccccgcctcgtgggcacacaggtgagctgaccgtacttgcccagccggtctgagggaagcgaggtcaggggcgacggcgccgcctccgcctccgcctccgcctgtcccctccctccgtccggcatccgcgccgctcaaggactccaaagtcagcgtcgcgaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatggtgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcagtctagcctgggcaacaagaatgaaactctgtctcaaaaaaataaaaataaaataaaataaactccatcttaaaaccaagtgagagatctgacctaaccaactccatcctacttttaacctccaaactgtccttgttcattcctgggtgtaggccaaactaactttggaagaaacttagtttatggtttcccgaaacaaatccttttcttgtctggagactagactgcctttgtaggactaacaaattagccacaagattagaaattatggtttagaattcatgcagctggagattacaagattctgaccctccctaaattgctcctggggataacatcactattgaaaaacctaacaacagtgcttgagatattttgcagaccttgcacttgctgaatcagctgggaccatccagatggataaactggctcatctgatcttgtggcccgcacccagcaaccggctcaggccaagaggacagctttgatccatacgatttcatctctgatctgacccctcagtgctcccagcttactggccccctacctaccaaattatccttaaaaactctgaactccagggctgggcacggtggctcacacctgtaatcccaggactctgggaggccgaggcaggcggatcacttgaggtcagaagttcaagaccagcctggccaacatggcaaaaccccgtctctactaaaaatacaaaaattagccaggcgtggtggtgcacgcctgtaatgccaactacttgggagcctgaggcaggagaattccttgaaccctgaaggcggaggttgcagtgtgctgaaatcgcaccactgcactccagcctgggcaacagagcaagactccatctcaaaaacaacagcaaaaactctgaactccgaattcttggggaaattgatttgagtaataataaaactctggtctcccgca

SEQ ID NO: 437947 - DNA, 1168 bp, Homo sapiens
catgttgagctgcaccttgtccccttccgccccagctaactcggtgaccagtggaggccacacccacgtgacacctgctgtccttgacagcagctccgacggcacctctgtggctctgcaggagccgcctccccgcctcgtgggcacacaggtgagctgaccgtacttgcccagccggtctgagggaagcgaggtcaggggcgacggcgccgcctccgcctccgcctccgcctgtcccctccctccgtccggcatccgcgccgctcaaggactccaaagtcagcgtcgcgaatcgacatctagaggagtactcaccacttaattgatgatcaatacacgttccttgaaagaaccgatagcatgcgatcgatacagagcatctgcactgggattgtccgccccgcctgtcagggaggcctcgggggctaatggagctgagggtatagtcggccttggaccctcgcttttttcctttcctgtactatgaagataactgccttatctccccctcaggactgttttggggattaaataggacgtttaaattaccaacgctctttgaaataaacatttcaaaattattataaccctttagtacatgtgggaaaacgttgacattcatgttcaagtttatttttctgctggctcatttaggtttgttgaagccttgagtccctaggattgtctaagaacatgggtaaatgtgtgtggaggcctccctggaggccagagaactgccagcagccttcatggtgttaggggaacaggaacctaggagagccagggtgacatcgttttaaaatcaacaacccatcttggcgggcgcggtggctcaagcctgtaatcccagcagtttgggagaaaaaaattagccgggtgtggtggtgggcacctgtaatctcagctactcaggaggctgaagcagaattgcttgaacccaggaggcagaggttgcagtgagctgagatcacgccatggcagtctagcctgggcaacaagaatgaaactctgtctcaaaaaaataaaaataaaataaaataaactccatcttaaaaccagtgaaactggcatccgggctctggaaattgccttgagcagaggaaacactctactcccgctcggcatcaaggcctgggtgatggagagtcaggcgtggtgcccctggggc

SEQ ID NO: 437948 - DNA, 952 bp, Homo sapiens
accacaccctgctaagtttttgtatttttttttagagacagggtttcaccttgttagccaggctggttttgaactcctgacctcaagtgatccgcccaccttggcctccgaaagtgctaaaattacaggcgtgagccactgcacctggccgatattcctgttcttaatggaaatttgataattgtactgtgggttattagcacatcaaaacaatgttgtagggaattagaacacaaagcgttagtatattgagtcttgttcttaaagttaactgtaggacgttgaattttttttataaagtacaattttgctgaactaaaactctaataatggcacctaaactgaatatttgaaaatgtcttggtaggcttaggacttatttttaatgtaaggatagcagcgtgccttagttttgagtaggtattcattacccccctaaaatagtggattttacttttcagtttcttgagttgtgtcttgaaattattgtttgtaaaaatgtttcttttgattttggagggaaaaaaatcaaaaagttttagtgcttctgtctacttgtagatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacagacctgacttggaactgtgcccaggacgacggggatcctggagtcccttccgtctatcacttctgtctgtgtcatagagctcccttatctc

SEQ ID NO: 437949 - DNA, 1000 bp, Homo sapiens
caccccaacgccgcttctgcggccaaagtaggttgggagtggaaggtggtggctgctgctccgcagtgtggggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgtcacagatgaagacatcaggaaacaggaagagcgagtacagcaagtacgcaagaaattggaagaagcactgatggcagacatcttgtcgcgagctgctgatacagaagagctggatattgaaatggacagtggagatgaagcctaagaatatgatcaggtaactttcgaccgactttccccaagagaaaattcctagaaattgaacaaaaatgtttccactggcttttgcctgtaagaaaaaaaatgtacccgagcacatagagctttttaatagcactaaccaatgcctttttagatgtatttaggatgtatatatctataattcaaaaaatcatgtaataaagagtcctaggacttaaaaattagtcttaagtaaatatcaagcaggaccctaagatgaagctgaagcttaagatgcaggtgaatctactggaatgtagattacgtaaaacatttgttacacaaagttaaataggaacagatcaggaatcttaatacataccagttaacgatactgggaatcaataatataacaatattaaaacaattgaagggacgccgtagtactaacaaaaagtaagcaataagaaatataagaaaacaaacaagggcgctgaaaccgaggaaaatagaaccaaataaaagacaagacacaaaaaaaccacacacgaggcaaagaaagaaatcaaaagcacagaacaaagaaaaaaagcactaaacacaaaaaaaagaaaaaacaaaa

SEQ ID NO: 437950 - DNA, 2509 bp, Homo sapiens
caccccaacgccgcttctgcggccaaagtaggttgggagtggaaggtggtggctgctgctccgcagtgtggggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaataaaaatg

SEQ ID NO: 437951 - DNA, 2185 bp, Homo sapiens
accacaccctgctaagtttttgtatttttttttagagacagggtttcaccttgttagccaggctggttttgaactcctgacctcaagtgatccgcccaccttggcctccgaaagtgctaaaattacaggcgtgagccactgcacctggccgatattcctgttcttaatggaaatttgataattgtactgtgggttattagcacatcaaaacaatgttgtagggaattagaacacaaagcgttagtatattgagtcttgttcttaaagttaactgtaggacgttgaattttttttataaagtacaattttgctgaactaaaactctaataatggcacctaaactgaatatttgaaaatgtcttggtaggcttaggacttatttttaatgtaaggatagcagcgtgccttagttttgagtaggtattcattacccccctaaaatagtggattttacttttcagtttcttgagttgtgtcttgaaattattgtttgtaaaaatgtttcttttgattttggagggaaaaaaatcaaaaagttttagtgcttctgtctacttgtagatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaataaaaatg

SEQ ID NO: 437952 - DNA, 1629 bp, Homo sapiens
cctatcagctgttcttgataaccaacaagaggcgcagtctgctcccatcaggatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaataaaaatg

SEQ ID NO: 437953 - DNA, 180 bp, Homo sapiens
tggtgaagaaggattgaaatattgcagcataggcagatttcaggaagatgtcttacagaaattttgttacattaccccaggctactgcactttacatatttgaaggacaacacattatattaagcgaaggaaaattgatttaactgctggcctctgaaaaattctcttttctcctaccag

SEQ ID NO: 437954 - DNA, 474 bp, Homo sapiens
ttgtagagaatatttataagaaccgtgaacctgtcagacaaatgaaagctctttatttcatcactccgacatcaaaggtgagtattttgagaccttaaaaagcaggttcatcaatatttcaccattgttatggtttactaacagaaaattcaaagtaataaagtacactttagtagaaaaatattgccataaactagtttgcttaggaaagtttttttctgtgttagaagattatttgcattcttccgaatgagaatgtataagtaaaaggattccttttttccccatatatgaaagcagaattaaattgtataaaataacatttctttgcatgttttgtttttcatgcagttcctattgaactataccttttggggggatggtaatgtaggtaaaagaaataatctatagtcttggattacttctttatctcagtgactttcctgtagcatatttgtatgtatatatgaagat

SEQ ID NO: 437955 - DNA, 2756 bp, Homo sapiens
caccccaacgccgcttctgcggccaaagtaggttgggagtggaaggtggtggctgctgctccgcagtgtggggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggtaatggagataatcactttttaataagtattttactattgatcataaaagaatctttgaaaactgaaagatagttgctgaacttggttaagataaaagggaaaatatgaaatcgagagaagactgaaggagatataatttgactgttttttattttaaaagcttcattcatgggtactacctaaagccttgaaattattttggtagcaattgtgtgattgtgcactcatatttttacctatttaaggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaataaaaatg

SEQ ID NO: 437956 - DNA, 1089 bp, Homo sapiens
caccccaacgccgcttctgcggccaaagtaggttgggagtggaaggtggtggctgctgctccgcagtgtggggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaagcaagtataacttgaagggcatataaagggcatatacaaacaggatagaatatgagcatttaatgatttatataggcaccagaaatctgaaagcccctataaccttttctattcagagactttatccttctcttattcctacagttatagtctttgacagataatgttgaccttgtaaattaaagtgtaatttgattgctttgg

SEQ ID NO: 437957 - DNA, 3286 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437958 - DNA, 860 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggccgcgcacctgtcacatgcccctgtggtcactctggccccgtgtcttccc

SEQ ID NO: 437959 - DNA, 586 bp, Homo sapiens
ctacccccccccccccggggggtttcccaaattctcccgggggttcttttaaaaggggccctcaaaaaagttcaccttctttcccttattccggaaaccttttccccccaggtttaaatggggccccctttttaaccccggatttttttttttttttttttgtaaaaccctgacccgtttgcaaaatttttttttctaggaaaattgtgaatggcaataaattcttctgggctaaaaaaaaaaaaaaaaaaaaaaaaaaaaaaaaaaaaaaaaaaaaaaaaaaaaaaaaaaaaaaaaggtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437960 - DNA, 3176 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437961 - DNA, 3368 bp, Homo sapiens
tgggtcctgaacttagtagattgggtttcccacagaattctccccttctttgctgttgtgacagctcttttcccagaagtcagtgggaaaaacagctttttaaaattgccaaaacaatacaagcttttagtaaatttagacacccatagagctgtctcagatagcgccccaggtaagctccgcacgccttccaggtgtgcacacagccgtgtctgccgtggcgctgtgggagttcacatctccatctgctcacgggggtgttgtctgcccttccccagagttgcccatctgcctgtggcactggccctggcacccttgaactgaccccgtcatggatgcgtcccacatcccactgcaggaacgtcccgggtggggtgactgggtagcacgaggcctccccacctcatctggagccctgtagtcctgccacatccacgtgcttctgacggaaggctttgcactgcgggcaactccggcttgattccaggccctcggccctcttgcctcacctctccccgctgcctcctgccaacagggagagtgcagagcccactgtggaggcctctcgtgttgcccatgaggctggcattgctggggtttcagcacctgagcccgagcagccactcagagctgaaggccaccctggcctcagagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437962 - DNA, 3316 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaagttttggggtcacaagcagcagccggagccggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437963 - DNA, 3195 bp, Homo sapiens
  misc_feature (3152)..(3152): n is a, c, g, or t
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcaaaaagtaaatataataaccaaaaccccatccacaaaaaataataacctttcccttctacanatacaaaccaataaacctagaaccaatactaaaacctctcctt

SEQ ID NO: 437964 - DNA, 2546 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437965 - DNA, 3178 bp, Homo sapiens
tgacccaggatcaggagaggctgagctcctttctcagcagcttcttcctatggccccagcctccgtgccctcttccctccaggggggactcggtgcctgcctggggaggaaggagaggcgttgcaggtcagcatggggtggctgcagccggcgttggcctcaggcacaggctccacagggcctgttcccaccagcccggcccggcagggccgcatggtggcgcgtgagggaggaccctggagggggaccttcctgcaagaattggtgggggccgcggtctccgccttctagaggtggcggcctactgcccttcgggtgttgtgtgcaaagccccgtttcctgctccctgcgcttgtatcctgctgccttccctcctgctggtgaagctcgtgctgccctttgctggcctgtgctgccactgccgacccgtgtcccgtggtggagctgtcgtggggctcacgtgacttcccttcctacaggcgtccgagctgggccacagcctgaacgagaacgtcctcaagcctgcgcaggagaaggtgaaggagggaaagatttttgatgatgtctccagtggggtctctcagttggcgtccaaggtagggagcctgccagatacgcgggcacagtcgaagccagtctccatattccacggccctgggcgtgagagcagggtgtgccccgtgcagccctcagcccagcttggcagtggccgctgtcctctgagacgggaggagagctgcccagcctgacagcccgagggatatggaaacaacttggcccactgcggcccggtcagccactaactgtcacttctccctctgctcttatcttgctgctgctggccttttcctcggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437966 - DNA, 2812 bp, Homo sapiens
gctggaatccctttggggccactgtagaactttctggggctcagcctgatgggtatccacatgcccctgatatttcggatgccctcacccgggggattcctgcactcctgaagctttaagctttcatctctcccgcccccattaatgccgctgtcttcatccgtgcaggtgtgaaggagggaaagatttttgatgatgtctccagtggggtctctcagttggcgtccaaggtagggagcctgccagatacgcgggcacagtcgaagccagtctccatattccacggccctgggcgtgagagcagggtgtgccccgtgcagccctcagcccagcttggcagtggccgctgtcctctgagacgggaggagagctgcccagcctgacagcccgagggatatggaaacaacttggcccactgcggcccggtcagccactaactgtcacttctccctctgctcttatcttgctgctgctggccttttcctcggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437967 - DNA, 1692 bp, Homo sapiens
gtcatagccgactctagagtgtaaaattcaggccagggaagccgtactgatgcccataggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437968 - DNA, 1361 bp, Homo sapiens
tgagtcgcctagtttgacttcgggcaggcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437969 - DNA, 1416 bp, Homo sapiens
cgcctgctgggcctgtgctgtcagacccgcgtcggtcgtaaccctctgtggctcccctgcatcagcagtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437970 - DNA, 2803 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacttcagcccccacccccgccctcaggagttgagggcatggatatgtttctttttttatttacactttttatgtgtgccggtttgccgggataaacagggcctttggcattgtgtaaaaaaaaat

SEQ ID NO: 437971 - DNA, 2397 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437972 - DNA, 362 bp, Homo sapiens
ctccaggcgggccgtggggggtgcgctggagtcgacggtgcccgagggcatcgccaggcgcctttatgctctcgaatgccctgtgtctccttgtcaggtggtcgctctggccgaaggcagagagtggtctctggagtcatcacctgcccagaactggaccccacctcagcccaggacgctgccgtccatggtgcaccggtagctgctcctcgtggggccttagtacagtttccactgggtcctgaacttagtagattgggtttcccacagaattctccccttctttgctgttgtgacagctcttttcccagaagtcagtgggaaaaacagctttttaaaattgccaaaacaatacaagcttt

SEQ ID NO: 437973 - DNA, 755 bp, Homo sapiens
  misc_feature (70)..(70): n is a, c, g, or t
agcagttttgcccttgtttccccaaagtggaatttacccctcttaaaaggaaccaaaagcggaggccccnccccggtgccgccgccctagaactattggattccccgggttcaaggaattggcgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437974 - DNA, 3360 bp, Homo sapiens
cggatctggaatctcccaccggttacgggagtccagagggtccctgcccacgcacgtcgcctcccggggcgcgagcaggaccctgccccgtccgcttcaacacccttttcccgagctccttcggacccaggactcggcctggacacatcccagtcaggtggcctctgaagcccggtggggcttccaccccctaagaacatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437975 - DNA, 2921 bp, Homo sapiens
tgacccaggatcaggagaggctgagctcctttctcagcagcttcttcctatggccccagcctccgtgccctcttccctccaggggggactcggtgcctgcctggggaggaaggagaggcgttgcaggtcagcatggggtggctgcagccggcgttggcctcaggcacaggctccacagggcctgttcccaccagcccggcccggcagggccgcatggtggcgcgtgagggaggaccctggagggggaccttcctgcaagaattggtgggggccgcggtctccgccttctagaggtggcggcctactgcccttcgggtgttgtgtgcaaagccccgtttcctgctccctgcgcttgtatcctgctgccttccctcctgctggtgaagctcgtgctgccctttgctggcctgtgctgccactgccgacccgtgtcccgtggtggagctgtcgtggggctcacgtgacttcccttcctacaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437976 - DNA, 3480 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgtcacgctgccatccgaccaccctcggctcccgagtccacgcctgcctggacctgacagcattccaataaagcatacgggaacatg

SEQ ID NO: 437977 - DNA, 2519 bp, Homo sapiens
cgcacacacctggcaccgctgcagagtggccggggcgtctgtgtctgtacgtgtgtgcgaggcaccccttgtttctggattttgcctgggtcttctcagcgggacggcgcgtgccggcttgcgtgtgggggcctcctgaagctgcctgtgccgcgacagggcctgcctaacctctcttcccgtctccttccagggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcaaaaaaaagtctggatgcatcc

SEQ ID NO: 437978 - DNA, 2552 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcaccaagttcaccaggttcaccagacacggcctccacaatagccacacccacacctgagctgttctcagggcccaggtggaaggcgcggacctgacagcattccaataaagcatacgggaacatgcaaaaaaaagtctggatgcatcc

SEQ ID NO: 437979 - DNA, 2386 bp, Homo sapiens
aagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggcatctggatctgcctggagtgctcggggagacaccgcgggcttggggttcacctcagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtggtcgctctggccgaaggcagagagtggtctctggagtcatcacctgcccagaactggaccccacctcagcccaggacgctgccgtccatggtgcaccgagtctctggccagccgcagagtgtgaccgcctcctcggacaaggcttttgaagactggctgaatgatgacctcggctcctatcaaggggcccaggggaatcgctacgtggggtttgggaacacgccaccgcctcagaagaaagaagatgacttcctcaacaacgccatgtcctccctgtactcgggctggagcagcttcaccactggagccagccggtttgcctcggcagccaaggagggcgctacaaagtttggatcccaagcgagtcagaaggcgtccgagctgggccacagcctgaacgagaacgtcctcaagcctgcgcaggagaaggtgaaggagggaaagatttttgatgatgtctccagtggggtctctcagttggcgtccaaggtccagggagtcggtagtaagggatggcgggacgtcaccacctttttttcggggaaagcagagggccccttggacagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccacattccaataaagcatacgggaacatgcaaaaaaaagtctggatgcatcc

SEQ ID NO: 437980 - DNA, 209 bp, Homo sapiens
gtgctctcaggggtgacgtgaaggcactgcccacgtaggccacatggttctgggggtgcttctggggttacctcagacttcacccagttttggccttaccagccttcgattctcggtttcagagtctctggccagccgcagagtgtgaccgcctcctcggacaaggcttttgaagactggctgaatgatgacctcggctcctatcaagg

SEQ ID NO: 437981 - DNA, 3989 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437982 - DNA, 3936 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437983 - DNA, 4055 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctcttctagaaatagcgtgttctcagggttttataagccttgaaggggtataacggtattcctaagccgtggagaaagtttttggggcatatcctgtgggggggccatgggggaattgtggcacgagtggtagtggagagtatatgggcatattacacagtggtcttaggtctatgggccaccagaatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437984 - DNA, 3942 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaagcaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437985 - DNA, 3994 bp, Homo sapiens
tgctggtattacagagtgtgagccaccggacccaggcctgagtttctctttctctctttttaactttattttttgaaaaacccggtagactttgtggggagcatttttgttgataattttactgatctaaagctgagtgatttttttaaaagaatttgaatttggcttcctcaccagtaatatgtctccttgcttctttgatgtgatagttttgagatgacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437986 - DNA, 3852 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437987 - DNA, 3935 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaatgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437988 - DNA, 3832 bp, Homo sapiens
ttttttagcaaaaatgcaactacatcccctccatgtgcatttcatacactaaaggccattttgtggtggtgtggtgggttttcccagggttttctaaaatccttttcaggtacatttcctgccccgccccctgcaggtcttccaggatgcaaagccagtgtgctcactcttctcaaagtgaggtgccaggccaccgagcgtagggtccttcagcagtgcacaggatgtgggctctggcttcttcaagtaccgtggaccacggcccttgggtcaacagcaccggcggctggcttgcatggttggcttctcaactttgattgttccattgtttccattttcatgggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacgggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437989 - DNA, 3392 bp, Homo sapiens
gtcgacgatcggtgtctggtgactcttggtaatcggtgctgcgcggcgaaggagtggactgtgagaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437990 - DNA, 2599 bp, Homo sapiens
  misc_feature (21)..(21): n is a, c, g, or t
tggctgtctctagaggatccnctccccgtacgcgcaaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437991 - DNA, 2100 bp, Homo sapiens
tcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgacccccccctcgtgccgaattcggcacgagggcaaatcttaccccgcctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437992 - DNA, 1944 bp, Homo sapiens
ttttttccacattgtccacattaatggttggcatgattgtgcttgcaggccaagaaatgatcataccccttgccaaaggtaaaaaaaaaaaaaaaaaaaatgagttgaaaattgaagtgacctctttccagctgacttgcaggcttggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437993 - DNA, 2047 bp, Homo sapiens
tcagcctggacgacagagtgagactccatctcaaaaaacagacaaacaaaaaagtcagcccctgcacatctctgtagtgcttttcatgtattcaaaccacttccgtatatgacctctcacttagtcctcatgacaatggagcacttattattcttcccattttacagatgaggaaactaagacccagaaagttcaggtcctctgaccccagaagtgtctgtgatgacccccccctcgtgccgaattcggcacgagggcaaatcttaccccgcctggtaccttctttgccatgagcattcaagggacagctaacctttattgacaatctatattgcaaaatcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437994 - DNA, 432 bp, Homo sapiens
acccacgcgtcgtttttttttaaaactgaaaatatttattagtatgaatcagtgtgtgttaaaccaaaaataacagatacaattaggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437995 - DNA, 795 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattaggtaagatgcattgaaatctcttttgtgtagatactgtcctccatccctgagtgtcatccgtgtagatactgtcctccatccctgagtgtcatccgtgtagatgctgtcctccatccctgagtgtcatccgtgtagatgctgtcctccatccctgagtgtcatgcgtgtagatgctgtcctccatccctgagtgtcatccgtgtagatgctgtcctccatccctgagtgtcatccgtgtaga

SEQ ID NO: 437996 - DNA, 529 bp, Homo sapiens
gaagaaggaagggaggaaggaaaggaaggaaggagaaaggagcccctccaggaacacctttattttgtgcacagcccaaagcaggagtgttgaagcagggtgaaaatctgtgtgtgcagtgttggctgtaggaaagggaactcacccttggcctcctttttgttgcaggccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgc

SEQ ID NO: 437997 - DNA, 3936 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437998 - DNA, 3935 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 437999 - DNA, 4121 bp, Homo sapiens
ttttttagcaaaaatgcaactacatcccctccatgtgcatttcatacactaaaggccattttgtggtggtgtggtgggttttcccagggttttctaaaatccttttcaggtacatttcctgccccgccccctgcaggtcttccaggatgcaaagccagtgtgctcactcttctcaaagtgaggtgccaggccaccgagcgtagggtccttcagcagtgcacaggatgtgggctctggcttcttcaagtaccgtggaccacggcccttgggtcaacagcaccggcggctggcttgcatggttggcttctcaactttgattgttccattgtttccattttcatgggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 438000 - DNA, 3935 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaaggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 438001 - DNA, 3909 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcgggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgcggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 438002 - DNA, 2887 bp, Homo sapiens
  misc_feature (12)..(12): n is a, c, g, or t
ggccggcggcangtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattaggggggtgattcttaaaggacattaggattggtgctcagaaatggttaatcatgctgtgtgctagccagggccagctggtaccttctttgccatgagcattcaagggacagctaacctttattgacaatctatattgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgacttgcaggcttattttgtaacctttcctcatccagttttccctgagaacctgggtttatctctagatagctgttcaggttttttagctgaggggtaagtatcctagctgagagttttgcatctttgggtggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 438003 - DNA, 1424 bp, Homo sapiens
gctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438004 - DNA, 1888 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaactgtgtcttcctggagactaggctggcattttgactttggggtacggagtctcgctttgtcgcccaggctggagtgcagtggcacgatctcagctcactgcaagctctacctcttggttcacgccattctcctgccccagcctcccaagtagctgggactacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438005 - DNA, 1722 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438006 - DNA, 1585 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438007 - DNA, 1626 bp, Homo sapiens
  misc_feature (161)..(161): n is a, c, g, or t
  misc_feature (193)..(193): n is a, c, g, or t
  misc_feature (262)..(262): n is a, c, g, or t
gcagtgactcaggcagcctcctttgtcagcaccgggcctgagtcgctaagcggctctctgactcagatgccctgaggtacaaagttccttgagcttgggtgaatggaaacattagacattgggttcttctgtgcggttttattatgagaatttgatcaaanccacatttattaagtgtccatctcaagttgcnttatactgagttcgcttcctcaagatgaccatctgaaacaaaacacgtgtgctttctctagtggctganaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438008 - DNA, 1510 bp, Homo sapiens
agtctgtttctctgtcaccggatgtggtgtgagacgaattgataggtgttcatgttttctgtttctctttcttgcaggcaatacataagggaaatccctttgttttttagaagcatctctcacacacagacatgtgcatacatgcacatctgtctaacctgttgctctaaaatgcagcaagagaaaagcagcctagtcttaattgatttcagcagttaggtggtcctggggcatgaatgtgggtgcgccagggtgcctcggcccaacttctttccttgtttgccctgcagattcgcaaggggcccctatgctgtgggtccaagccctcctgtcctgcctctgactgtcttgtgtggtctggccccacaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438009 - DNA, 1588 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcagtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438010 - DNA, 2226 bp, Homo sapiens
  misc_feature (1737)..(1737): n is a, c, g, or t
  misc_feature (1787)..(1787): n is a, c, g, or t
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaanaaaaaaaaaaaaaaaaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaaaaataaggggggcggaggcgcgcggcgcgccacgaaaaaaaataataacaaaacacacctaggggggggcgggccgcgcggcggcagtagtagagaacagagctacgacaacaacgggtgatacgcaaagcacgacacgccgcggacgagccaagacaggcaggggggggctgacccgaccaacaaaaaaaaaagcggcggcggcggggaggagaagacaagcggagagtaaagaaaaacaaacacatacaagggaggacggtatcgccggacaacgagaggtggaagagagctacaaaagaggaggcaggaagaacgaagagggggagagagaaatcaaaaacagaatgatcacgccgcgccggggggtgagatgaat

SEQ ID NO: 438011 - DNA, 1746 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaacaaatgccaggcacagagtgtg

SEQ ID NO: 438012 - DNA, 639 bp, Homo sapiens
  misc_feature (36)..(36): n is a, c, g, or t
  misc_feature (62)..(62): n is a, c, g, or t
  misc_feature (65)..(66): n is a, c, g, or t
  misc_feature (89)..(89): n is a, c, g, or t
  misc_feature (100)..(100): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (120)..(120): n is a, c, g, or t
  misc_feature (122)..(123): n is a, c, g, or t
  misc_feature (131)..(132): n is a, c, g, or t
  misc_feature (134)..(134): n is a, c, g, or t
  misc_feature (136)..(136): n is a, c, g, or t
  misc_feature (142)..(142): n is a, c, g, or t
  misc_feature (146)..(146): n is a, c, g, or t
  misc_feature (149)..(149): n is a, c, g, or t
tgcacggccgaaggctcggtagtggcgttttaaagncgcccctcagaatgatggttttcttncgnngcattaagcaacgacgtagttancgtttccaccnagatggatatncntagananannttttctanntncnaactanttcntanatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438013 - DNA, 1295 bp, Homo sapiens
  misc_feature (1115)..(1115): n is a, c, g, or t
  misc_feature (1127)..(1127): n is a, c, g, or t
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcgantggggccaatanttcttgaggaaggggggtacgatggttcgtgaaatgccctcccggggggggggtctccaaaaggggtctcggccgtgggggactcttcccgattgctggcctcccttgtttctccgacgcgttccccggattgtggacctgccgtgtgcaccccggttgccatttttc

SEQ ID NO: 438014 - DNA, 1628 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtctgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438015 - DNA, 263 bp, Homo sapiens
gctgcacagaaggttggggccatccaaccaggcagtccgcctgcacagcagctgtccctgctcatcgggctggaggacagaagacagaaccctaaaaccacaggtaagggccactggttcccctgtgcccttctctcacccttgccatccttcccagcctgtctctgcagcagctctgtaggcatcttgttgcatgcagagggagtgtccagccctgggaggaagctctcaggcactgggagctcgctgaccccagcagagat

SEQ ID NO: 438016 - DNA, 1765 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaactgtgtcttcctggagactaggctggcattttgactttggggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438017 - DNA, 1351 bp, Homo sapiens
gctgcacagaaggttggggccatccaaccaggcagtccgcctgcacagcagctgtccctgctcatcgggctggaggacagaagacagaaccctaaaaccacaggtaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438018 - DNA, 1501 bp, Homo sapiens
gctgcacagaaggttggggccatccaaccaggcagtccgcctgcacagcagctgtccctgctcatcgggctggaggacagaagacagaaccctaaaaccacaggttgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacaagcatgagagctcagccaccagactgcccagtccagcccaggctctgtgtctcacttgctgtgtgccttggaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaa

SEQ ID NO: 438019 - DNA, 2303 bp, Homo sapiens
  misc_feature (1737)..(1737): n is a, c, g, or t
  misc_feature (1787)..(1787): n is a, c, g, or t
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcagaacagaaaaaaaaaaaaaaaanaaaaaaaaaaaaaaaaaaaaaaaaaaaaaaaaaaaaaaaaaaaaaaaaanaaaaaaaaaagggggggggggggaaaaaaaaaaacacaccggagggggcgaacacagtcacacggcaccccgacacacatgttgatagtaggacaaagagggcgccacaatataacgaagcgcagcgcctctaatagtaaaacaccagaggcagcaggcgaccggagctatctataacaaagctgcgtcgatatgagagcaaaacaacaagactaaaggaaggaaatacattgtagaagagagcaaaccccacaaaccatcgggcgggggagcgcgcgcaacaacaaaagcggaggcaacaaaagcaccaccccgagacaaaagaagaaaacacgcaccagcgcaagcagagtaaaataacaaaaagacaaacagagcgcagcagcaagacgtgagagagccaaacacaacgagacacggcaagtacagacacgccacacaagcgaagcagaacaattagcgtgccacgaacaagacaagaacacaacgaacgagaacgacgaccacgacggggga

SEQ ID NO: 438020 - DNA, 1504 bp, Homo sapiens
ggcacgaggagggtacgggccgggaccgccgcagcccggggcgggggcacggcaaccgcgaggcctgggggcgcccgccccccgcgccccacgcccggtgccagcgagccgaggcgtgcatctccttatatggtcaaatgacacggcggggtttctcgagggcgggagctgcgcagcgctccactcggccggcagcggagccgcagccaccagccgcccgcgccctccagccccgtccgggagtccccggcccgctgcggtgccgtgagtacctccaaccccctgcgccccggagggaggccgaggggcttagccaccagggctcggaagtgggggccgaatccggtgcgagacccaaggagaggggagcagagccggagttggggagactggttgctgaaaatgctgaaaagccaggagtcaaaatgactgagcgctttgactgccaccattgcaacgaatctctctttggcaagaagtacatcctgcgggaggagagcccctactgcgtggtgtgctttgagaccctgttcgccaacacctgcgaggagtgtgggaagcccatcggctgtgactgcaaggacttgtcttacaaggaccggcactggcatgaagcctgtttccactgctcgcagtgcagaaactcactggtggacaagccctttgctgccaaggaggaccagctgctctgtacagactgctattccaacgagtactcatccaagtgccaggaatgcaagaagaccatcatgccaggtacccgcaagatggagtacaagggcagcagctggcatgagacctgcttcatctgccaccgctgccagcagccaattggaaccaagagtttcatccccaaagacaatcagaatttctgtgtgccctgctatgagaaacaacatgccatgcagtgcgttcagtgcaaaaagcccatcaccacgggaggggtcacttaccgggagcagccctggcacaaggagtgcttcgtgtgcaccgcctgcaggaagcagctgtctgggcagcgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtggcataacgactgctttaactgtaagaagtgctccctctcactggtggggcgtggcttcctcacagagagggacgacatcctgtgccccgactgtgggaaagacatctgaattcaacacagagaagttgctgcttgtgatctcacacacagatttttatgttttctttctcacccaggcaatcttgccttctggtttcttccagccacattgagactttcttctagtgcttttcagtgatactcacgtttgcttaaaccctttagtgctttgtgatagttcagtcccagggaaagagaaaactcgccctaggccctaggtgggaaacatgcgaaccggtaccgagctgg

SEQ ID NO: 438021 - DNA, 988 bp, Homo sapiens
ttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatattctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctatagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaa

SEQ ID NO: 438022 - DNA, 4449 bp, Homo sapiens
ttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaacaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaa

SEQ ID NO: 438023 - DNA, 3548 bp, Homo sapiens
  misc_feature (23)..(23): n is a, c, g, or t
  misc_feature (60)..(60): n is a, c, g, or t
tacccgggggtttttttttaacncccccttttttttaaaaaaaaaaattttaaaaaaaangggggtttcccaatttttggaaaaatggttccttttttgaaaccaccctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaacaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaa

SEQ ID NO: 438024 - DNA, 4256 bp, Homo sapiens
ttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaacaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctataggaggaacaagagcactgggggaactctggagtatgagtaaggaaatgcttctcaccttctctgctccaaagagatatctgttacatcagggaacaagtcctctaggtcaggcacttcctcctgaccagtgcaacgggcactccaggttagaaactgtgtgtgctccctctctgtcagttacttgtctaagggctcctatccgtggtcatcagctctctggccatgagttctgtttgtgcttattgcagcagcatcttcacaacaaacaggtcagtaatcaacctgggaagggaaaagacgacagtaaatattaccccctgtagagccgggaggcatttacacctggaatggccttcttaactgatttctgcctggccacctcacccccagccaagtctgaacctgagcaataccaggcacagagaggtgtctacttgtaactccaacacttgacaaaaaacaaaactgaagctgtgattggtttaggcagcaagtggccaggtgcaacttgtttgtttttatttttgttttccccaacagtactgagatcacttgcacttttcctcatttcttaagaaaatccagtttgcttgccatgacttgtttagcgttaggtttacaaagcttgttgttgaatgttgaatatttgtccaaaggagtttgacaaaatagaagctgcttggtccctgttctgcctgctaggtcataaggatgaaggccatgtggctggggtacttatgtcaagtccagaatggggcagtgtccctctcctacctctctgcggagacgcaattgaaggtcaagtagactcagtgtagggcaggcagctgtcatgctgcaaagaagtttagaggagtctttgggttggggaggtgacaggtaggtaggacaggatctcttaagatgggaaagatactggggagaggagggctgcttggccccagggaactgcagtgaggtggaactgagctccgctcctgaatctccaaaggagcccatgctgcccggcttccctgagtcattttttccagcatcctgtcagatccctaacccaaagactcctctaaacttctttgcaacatgacagctgcctgccctacactgagtctacttgaccttcaattgcgtctccgtcgacg

SEQ ID NO: 438025 - DNA, 3505 bp, Homo sapiens
ttttttttttttaggaatgaaaggtcataagccattagaaatagtggcattattatgcaataacaacaccctagctaacctgcttttgtcatctgtagcacttacaataaagaatgatgaccttccaaccctggacactacctcgataaagcaaaccagagatcctctctacactttctatggaagccataaaagttgccatcaatatatccactttcatagttctatacttttatactttctagacttttttatagactttatgatcagatctttttgtctcagaggataggttttgcaagattcaaaggaaaatcaaactccttggttgttccagctttgaagcttttgcttcagtaaatttgtttaaagaaccagatcacataccatttatcaaattctttacttaagtcagaatactttgcagacatacatatttggaaaacaaactgtttcttgttcactagatagaatctgtattgtagtaagaaactacttacaaggtggctttctttctgctttgttactctatgtattactcaataatatatgtatggtcacaggttcctggagttgttttatttctttatgacagacacatgagtatgcacctctctctaatcctctgatgtcactgcagcttcagtctctctcactctgtttttgagtgccttcaaaatgccagcatcctggaacattcttttcctgatctaaatcctacctctgactatttcattatccatgaatattggaattcacccatattccaatgggcttaactctacaaactagctaaaaccttggacaagaattttgaccgtatttctgttttgttcctccatgtcatttttaggttatatttttaacttttatttatatcttatttcttcacatatttcgtctctctgttgaaagattttatccttatttgactcttcactttttttactttcaccagaaatttgacgttcctttaaaattaaaggtcattgaatgtcttttgaacacctttttctcaactgaagtcttcctgaatgcctcccctttctgatgaaaggatcctgagtgctgctgttgctctgccctgttcccatgtgcccactcccttccgtacacattttgcaagactatactctttattttagtcaaattaatttaaaattgctccctgggtttctgctctctcatggccctgtccctcaaaaacttctgtttactttttctagctgttttcatctaatttgtttaaaatgtatgatggatccataatatatgaaggatgtaatgaaaaggaggttgcagtgttttatataatatgatcgagcacctccgtgatgaaacatttagcaattggctagtccttcacagccagagtggaagtttgtgctgtggacaggtctttttactcccttccagttctcctccaaaactggagaaaaaggaaaaaacaaaaagaactctttcaaatgaggagatttgattgcatttttttaggtgaatgaaagcttggagttgagcatttgggccttagtcagcatttttcctttctgacttaaaatctcatgtccttttccttaaagttaatagtactcaggtttttaagactaataaccacacaaggtgggtatctaagaaggcagctgttaatacattctccatctttcctgtctggcaacaggaaagatattattggtgagatagtgcaaaattgtgagaattggttatgtttgatgatgaataaattcaagatttttgaaggcttcactgctatttgggatgggaaggtgagtttacaaaatgaaaaaggtagatttttatgttacagaaatcagtaacgggtttcttgttgtgttaattacctttcacttgatttgccatgatgtttcttcctcattattgatctagaagtttgcctcttggatagtaactagtaacttagtatctactttaaaatttgtggcttttctcttcagggtcccaggccataaaacaacggagagctgtacttgcttgtcacttggaggaaccacatccttgagacagcctgctgtcttgtatgtcttcagtaggaaacttctgacacacacattcaagggagttcctgcccctgagaagtgttcccatagctttccagtcgcaggttactttcacactacgtcagcttctctggtgagatcagggatgttacatattacttgaaaatgatttcataggaagtgaggatggggcaagaaaggaggtagaagctgaattttgcttaacttcagaaggaaatctgatacttgccttggctagttctgatcaactaaagagcctgtgtctgtactggatgtgccaaagagtcaagttgtttctggaatatccagctcctctgaatgaacacagcttcctccctacctgtcttttatgggtgaaaagggaccgtctgatgagcatgatagacatcctgtacaggactcaagactgtttcattgcatttgaaagttggtgggaagtattttattctgctagagctcctaaccctcctagaaatatcttttcatgctctattaattcaattcattagtttaaaaagaaacagtgtgacataattttggtgtttacttcttaagttgtctccccaagggcatatatgtagcctctgaaaatgggatgatttcttctcaatcttccataaatttgaatatgcattttattcatttcttgacatgggctgtgtgactgttttccatcagcagttctggctttgtccacaagggagcaataaagtacgttagctttattctcaaccttctaaagaaagatcccacttttaaatctcttctggaatagcctcttagctcaaagcttattcatgtattttgattatttaagaaattttcccttattacaaagtccagtcgtcgttcatccctcatgatgccaagcaatgattgatgtgtgggtgtggagtccttgtgggtcaggcatcttaattaattagactttttacatattgatgatccccagattgaaagccaggaccttcccataggggcgcctttgtgtgctaaaggcagagcaggcaggcttctccactcctatctcctccgcaggccaccaccatcacatctatagggaactgcagtgaggtggaactgagctccgctcctgaatctccaaaggagcccatgctgcccggcttccctgagtcattttttccagcatcctgtcagatccctcaatgtactgatttcccccttgtgttaactataccgatattatttttttagcaattgaaatgcacttttttatttcaactcaatcatgattttaagtataaaaaatttatagattgttaaaactacttttttgtgtatttttaaccactcaatgtagcattgtatattttattcttgtgagactctggtacaggtgtgccgcctaatgatttttctgagatgctgggcctttggatgtgtacggtaaccaacttaatgctaatgttcaaagtaaaaaaaaaaaa

SEQ ID NO: 438026 - DNA, 3569 bp, Homo sapiens
gttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcggggggcggaccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgtatgatcctgtctggtcaagctgctgacaatttaagggcaaaatggaatttttcaactttatgtgttcgcagaatttttagccttataggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 438027 - DNA, 2760 bp, Homo sapiens
gttcccacctatatcacaacactgggaggcttttctcttctggatttaccatcaaccatctggatattgctccttcgtgagtactaatataaagattgctgtgattgactttaaattatattttttaaaaatcctgataaaagccagagcggtgactcacacctgtaatcccagcactttgggagccaaggcaggcagataacctgaggtcaggagtttgagaccagcctcctaacgtgctgggattacaggtgtgagctgccacacccaggcaagatggagtattattctaacctcatccaacagagtttattattcagtttatctcctttggttatatgtattttaaaccacattctgtgtcagctattgcttctctctagaaacatatttttaagttgttcttgtcttgttcttctctaacaccatggaattttagctgagttttggccacatgtagatttaataacattgcataatgagattttccttttatagtatattagttgtattacgcccatgttttccagcattttttttttctcatgaaatttgttagtcttccaggcaatatagtgtttctacagtaggtggcagcaatttcaaatttcagatttataccatattaaggtagagcaaatattaatgctgggtgttttttcccttttataactttttaactccaggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 438028 - DNA, 1421 bp, Homo sapiens
gttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcggggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcaggtatggactttgacacattttaaaaataatgtcagaaactttttttcttcagaattaagatatcagtttttaaaaatatatattcctattgtgcatgctctagacaaagtagaataggcaaatgaaatgaacatccaaagtattgtctggctg

SEQ ID NO: 438029 - DNA, 419 bp, Homo sapiens
tttgagacggagtctcactctgttgcccaggctggagtgcagtggcacgatcttggctcactgcaaactccgcctcccgggttcacgccattctcctgcctcagcctcccaagtagctgggattacaggtgcccaccaccacgcctggctaattttttgtctttttagtagagacggggtttcaccttgttagccaggacagtctccattggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 438030 - DNA, 493 bp, Homo sapiens
gcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccggtaagcggcggggtcgtccaggggcttcgagtgggcagcggtaccgggggcggcggtctctgggccggcatggcccgggtacccgcaccctgcgccggcgggaccggagctgctcaggcgcgaggggacattaagaggggagcccgttcagagtgccgctcagtcccgcctgcctcggtgcgcagaagcccctcgggaaccccgggggccgcgaccgtgatcgcggagccgagccg

SEQ ID NO: 438031 - DNA, 460 bp, Homo sapiens
tttatcctaattattcctgttttcttcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagaggtaagaaaaaataatcatctgcttcttatatatatagtataagaccatacacagaatttgttctcatctgtataaaattcagttattctgtatcttccattttactctgctgtcctaaattttagagattcttatacatcaaaggactattaagaaaatgaaaaacaacccactgaatgggagaaagcatttataaatcaaacatctaataagggtctagtatccagacatattaagaattcttacaattcaataataaaaagacaactcag

SEQ ID NO: 438032 - DNA, 3634 bp, Homo sapiens
gttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcggggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagctttcttcacagaagtcagtgccgtgggtacccattttaaaatccctgccactttgggctatcgtagttgcacacttttcttacaactggactttttatactttattgacattattgcctacttatatgaaggagatcctaaggttcaatgttcaagagaatgggtttttatcttcattgccttatttaggctcttggttatgtatgatcctgtctggtcaagctgctgacaatttaagggcaaaatggaatttttcaactttatgtgttcgcagaatttttagccttataggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 438033 - DNA, 3475 bp, Homo sapiens
gttcggtcgaagccctccccttaattatgtgcaattcaagtccccactgcccgcccgcaagcccccactcatcctcgctgcgggcagggtggcccctgcactttacaagggggtgcaggagcgggagacggtcgtccgaacaccggctccccggcatgcgtagaccggcgggcggagcgggctcactttgcgccaatcctacgagaactcccagaactccgcttccctagtccaacccaagccagagttgcccacacctaagatggcggcggggggcggagtcggcgcggccgcctctgggcgggaccgcggggactagacgtggccgcggggcggtgtcatcgcccccgccccgcccggtccagccagctcggcccgggggcttcgggctgtcgggccggcgctcccttctctgccaggtggcgagtacacctgctcacgtaggcgtcatgaggtctccggttcgagacctggcccggaacgatggcgaggagagcacggaccgcacgcctcttctaccgggcgccccacgggccgaagccgctccagtgtgctgctctgctcgttacaacttagcaattttggccttttttggtttcttcattgtgtatgcattacgtgtgaatctgagtgttgcgttagtggatatggtagattcaaatacaactttagaagataatagaacttccaaggcgtgtccagagcattctgctcccataaaagttcatcataatcaaacgggtaagaagtaccaatgggatgcagaaactcaaggatggattctcggttcctttttttatggctacatcatcacacagattcctggaggatatgttgccagcaaaataggggggaaaatgctgctaggatttgggatccttggcactgctgtcctcaccctgttcactcccattgctgcagatttaggagttggaccactcattgtactcagagcactagaaggactaggagagggtgttacatttccagccatgcatgccatgtggtcttcttgggctccccctcttgaaagaagcaaacttcttagcatttcatatgcaggagcacagcttgggacagtaatttctcttcctctttctggaataatttgctactatatgaattggacttatgtcttctacttttttggtactattggaatattttggtttcttttgtggatctggttagttagtgacacaccacaaaaacacaagagaatttcccattatgaaaaggaatacattctttcatcattaagaaatcagaatgggtttttatcttcattgccttatttaggctcttggttatgtatgatcctgtctggtcaagctgctgacaatttaagggcaaaatggaatttttcaactttatgtgttcgcagaatttttagccttataggaatgattggacctgcagtattcctggtagctgctggcttcattggctgtgattattctttggccgttgctttcctaactatatcaacaacactgggaggcttttgctcttctggatttagcatcaaccatctggatattgctccttcgtatgctggtatcctcctgggcatcacaaatacatttgccactattccaggaatggttgggcccgtcattgctaaaagtctgacccctgataacactgttggagaatggcaaaccgtgttctatattgctgctgctattaatgtttttggtgccattttctttacactattcgccaaaggtgaagtacaaaactgggctctcaatgatcaccatggacacagacactgaaggaaccaataaataatcctgcctctattaatgtatttttatttatcatgtaacctcaaagtgccttctgtattgtgtaagcattctatgtctttttttaattgtacttgtattagatttttaaggcctataatcatgaaatatcactagttgccagaataataaaatgaactgtgtttaattatgaataatatgtaagctaggacttctactttaggttcacatacctgcctgctagtcgggcaacatgaagtaggacagttctgttgattttttagggccatactaaagggaatgagctgaaacagacctcctgatacctttgcttaattaaactagatgataattctcaggtactgataaacacctgttgttgttcactttcctcataaaaattgtcagctctctctgacacttagacctcaaactttagcatctctgtggagctgccatccactgtataatttcgcctggcaactggactgaggggagtgtgcccaggcagctgccaagcactccctccctggcttcagggtcagagtgcccagcgtttatcagaggcagcatccaagcccagagccagtgtcgactcttcggctggtgcctttcctctgaggggctatcaatgtgtagataaagccctgagtaggcaagagcagtgagatccactgctatggtcttgatacatcctcaaactttcccttcccagcacagaggaatattggctggcatgcaacctgcaaaagaaaaatgcgaagcggccgggcacggtggctcatgcctgtaatcccagcactttggggggctgaggtgggcgaatcatgagatcaggagttcgagaccagcctggccagcatggtgaaaccccatctctactaaaaatacaaaaaattagctgggcgtggtgacgggcgcctgtaatcccagatactcaggaggctgaggtaggagaatcacttgaacctgggaggtggaagttgcagtgaaccaagatcacgccactgcactccagcctgggcgatggagcgagactccaactcaaaaaaaaaaaagaataaagaaagaaaagtgcgatgcccagtcaatcacaaataagatcatcctggtttaaatctactctcacatggatcacagtataaatttctatgtgctgtgttttgttcgtttgtattttgtagagatggggtctcgttttgtcgcccaggctggttttgaactcctggcttcaagcgatcctcctgtctcggcctcacaaagtgttgagactacaggcatgagccactgtgcccagcctgttctatgtttttaagctacacgagaattttttttttaattaattctcactgtttgttcagtctgtcttcatctaagtttgtgttgcagtttaaagttaaagtgacttttaaaggccacatcacctgagactagggtaatcatctttacttctggttcctgaaatcatatttttccagtggaccatcctccagtggctgtggttgttgagcatgctttcagaacacctatgtggcttaaaacttagtttatgttttgtgttcaacactacgtgtaatattttaaaactgtttaatgtgatgtgaatacatttatgtacatttatttttaaatttgtaaatagctttaaattgctatggcaatgtttcttttataaatcatcaaaataaacctttgtgaattga

SEQ ID NO: 438034 - DNA, 3618 bp, Homo sapiens
ggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttttttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438035 - DNA, 3535 bp, Homo sapiens
aacagatgccacagcccccattttgccaacgaggcagctgaggttcccagaggctcaataccagcaccatgagccgcagcacgcaaggcaaacacagccggagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438036 - DNA, 3484 bp, Homo sapiens
ggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438037 - DNA, 2894 bp, Homo sapiens
cttagatttaaaggcagacagtttgctttagtacaatagtatacattttataatgatgaacttataattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438038 - DNA, 1277 bp, Homo sapiens
aaaaaaaaaaaaaaaaaaaaaaaaaaaaaaaaaaaaattaaggtgttccagtggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438039 - DNA, 3672 bp, Homo sapiens
ggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438040 - DNA, 3504 bp, Homo sapiens
caggaattcttagccaggttcctgtgcgcccaccgtgaccctaagagaagaggcggacgccctggcacgtccttccctcctgcttcccccgcccaaagcgctcccggttcccggggcgtcaggttggctgacagttcggggtccctgcgtcctgtctcctcagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaacaaaagcacacaacgattatagtaactataagatacaataaaacaaataaatgtgaaagtagattcatgaaaatgtattcctttaaaatattgttttcctacaggcctatttaacaagatgtttcattttactgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgatacacaaagctttcttttctaacttttccaagcaaaatctaaaatgttttatgacatttttctggctgtgatcttaaaataattcatatctaaatagtattttgtctaggagatgctttctctctagtagttagaaattaaatctgtgtcagcattcctattaatgtctcactttactttcaagtaatattggtgctatttaacattttacagtaaatgttacttctgatactttagtacaatttcaactacagtgattcatgtagagagacaggggagttgtcaacttgggctactgaactacatgcataaactaaaaactaacagctacaaacttttaagatttctctaatattggtatgtaacacaggataaagttattcttgtcattttgaactgtagagtcctatttcagtgtgatgaatcactgttgctttgaaaaatctcattatttctgggccgggcatggtggctcacccctgtaatcccagcactttgggaggccaaggcgggtggatcatgaggtcaggagatcaagaccatcctggccaacatggtgataccccgtctctactaaaaatacaaaaaaattagttgggcatggtggcatgcacctgtagtcccagctacctgggaggctgaggcaggagaattgcttgaacctgggaggcagaggttgcagtgagccaaaatcatgccactgcactcccgcctggcaacagagcaagagtctgtctcaaaaaaaaaaaagaaaaaaagaaaaaagaaaaatctcattatttcaaaatgatagacatataccaaaaacaagtctataatgtgagtagttactaaaatttacacatcttaaaagtgtgtaaatgcttaaatttcagaattaccatcagaacctcaattgacattcctttgaataggctaataagtgacaaataagattaataagatttttcaaaatcgccaggactggtgaatataaatgatgattgaactggaataatattggggaccaaatcaaatgaatgattaaattatgaagctcatatccttttgaaggtagttgcaaagagacatttcaaaactgccctaggccattgcagcatccttagatgggacgcataatcattaccttaaagcatcaccactcattttgaccatatagattttattatgttagtttaaaaggtcaatcagcctcatgactttatagttatgtcttgtatttaaaaacattttttatacatttggttatgttgataaaccaaaaacatttgattaataaaatatctatttgaataaattatgagctatcctttcaaacagctattggcaagttttaaacccaaaatatatacacatagttctgtaataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataaattttctaaaagcctaaaaaaaaaaaaaaaaaaaaaaaaaaaaaaaaaaaaaaaaaaaaaaaaaaaaaaaaaaaaaaaaaaaaaaaagaaaaaaaaaaaaaaaagagacaaaccgaacaagcacaaacaaacgacaaaacaccaacaagaagaaggcggggcaccccgcacaaaatcacccgcagacgcaacacaagcactcatcacctgtcacgaaagcacagcccccaccgagctatcctccaacacagcagcgagccgcaaccaaacaacaaacagatcaacaaaaaaatcacagagcgcacaccagaggcacccccacaggtgggggagacacacgaggccaccccacaacaaccgaaaaaccacccgaccaacaaacaacaccgacagcagagcacccacccacagacgcggagagaaaccgcccgcagacaacaacaaacaacacgaccgcccacacacacgcccgccagacatcacgacaccgacaagctgagcgcaaccacgacaaccaccacgaccgcccccccaccgcacaagaaacggcagccgaccggcacaacccaccaagccaccacccgacaccgaaccagaccacccgc

SEQ ID NO: 438041 - DNA, 1297 bp, Homo sapiens
ggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatccgcgcctcggctactgcaaattaccgccatcctgcaattgcgccgggccaacccacccgcgcgtttgcgcctttgccaccgccgccgagctcactggcacagtccctcccgaaaggatcccgctgagctgcgatgtccccggactctaccccacgtgctagcctatcctcttccagccgcccgccgcccgccc

SEQ ID NO: 438042 - DNA, 114 bp, Homo sapiens
gtggctggatgctgaagatgactcagacacaggagcaagacagtggcctctactcatgcctggcaagcaacgaggctggggaggcacggaggaacttcagtgtggaggtgctgg

SEQ ID NO: 438043 - DNA, 688 bp, Homo sapiens
  misc_feature (28)..(28): n is a, c, g, or t
atttgccaataaaaaagggggagggttnaggggggggctaatgagttttttttaaaaagaaactggggaccatgtggggttttctcaaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438044 - DNA, 900 bp, Homo sapiens
  misc_feature (700)..(700): n is a, c, g, or t
  misc_feature (706)..(707): n is a, c, g, or t
  misc_feature (711)..(711): n is a, c, g, or t
  misc_feature (716)..(716): n is a, c, g, or t
  misc_feature (723)..(723): n is a, c, g, or t
  misc_feature (732)..(732): n is a, c, g, or t
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgactcattgctcaggaacaaggggnctgttnnatcnactangatccanaaaggtagnacagatacttgctgggaagggggacattcgcgcgcaggcacaggcggggggagcccggtatccctcttggggtggtggaccagggggaaaaaaggggcgaggcgcccttatgggccgcgtgggtggcaggcggcgggacccccatgtttgaaggggacctctggtggc

SEQ ID NO: 438045 - DNA, 851 bp, Homo sapiens
  misc_feature (714)..(714): n is a, c, g, or t
  misc_feature (732)..(732): n is a, c, g, or t
  misc_feature (779)..(779): n is a, c, g, or t
  misc_feature (816)..(816): n is a, c, g, or t
  misc_feature (839)..(839): n is a, c, g, or t
cttaagagggacggccgggggcattcgtattgcgccggaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttggcgccgactgcagagccgggaggctggtggtcatgccggggttcctggttcgcatcctccttctgctgctggttctgctgcttctgggccctacgcgcggcttgcgcgcagcaacatcacagatgctttcctaagccagaggaagtgtgagcccaaaggacccttgatcaattctgaattctatactggctggctagatcactggggccaacctcactccacaatcaagaccgaagcagtggcttcctccctctatgatatacttgcccgtggggcgagtgtgaacttgtacatgtttataggtgggaccaattttgcctattggaatggggccaactcaccctatgcagcacagcccaccagctacgactatgatgccccactgagtgaggctggggacctcactgagaagtattttgctctgctaaacatcatncagaagtttgaaaaagtnccagaaggcctatcccttcatctacaccaaagtttgcatatggaaangtcactttggaaaagttaaagaccgtgggaaccactntgggacatctgggtcctttgggnccatcaaaagcc

SEQ ID NO: 438046 - DNA, 672 bp, Homo sapiens
tcagaacctgtgtttttcacaagaaccccagctcatttatgtgcacattaatgtttgaaaaacactgatctagaaaacaagtgcctgcctgcctgattttttttttttagatgttcagggaagagggtaacagtttctacattctgacatgcttgcaatctaaaagtgttttttattcctagtctttttgtttgtgaatgtttttatatatgtaggcataggacaaataactgtgatgtattattatgcagtatatagcttctatgtacttttgatgttttacacaaggaaaatcctttccatgtgtggatgaccttttatttcttaattgttaaatatagataattaggaaagttgataagcagaccgcattattggatgcagatgatcctgtgtcacaactccataaatgtgcattttaccttaaggatacagaaagaatgtatttgtgcctttctcaagaaagaataattcaatttcaggtatgtttttaaattactggtgaaatctaaaatgtacaaactgtgaggttagcagcttgcaaaaatatgaaattttcatttgctgttaattatatacaaatacatgaagctatacacagatatttatctcaggtatgagcatccttaacacacaatcctcagacatgcaagcaatccttcctcaaggaag

SEQ ID NO: 438047 - DNA, 5655 bp, Homo sapiens
gccaccagattgggtggaaggggctctttctacggcatttcatgactgagcctccaagaacaacctgtattgagtttctctttgagatgattggactgctctatccagcatcattgagtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438048 - DNA, 5579 bp, Homo sapiens
gtgcctctgtttgtggacgatgctgccttgtttgtgattctctcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438049 - DNA, 6018 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccattgtaaaagtcttctgtcgaatgtgcctgatgcatgtattatcgtcttttatttcagaatacttcataaagataaaattaaattctatattatagttggtgtatttacaatcttaccatgtacatcacatcaaagtgatagctctactaatttaatttccttgtcaatgtttttaactatatagtgctttaaagagattttttttccctgtgt

SEQ ID NO: 438050 - DNA, 5624 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438051 - DNA, 5403 bp, Homo sapiens
gcctactactactaaattaaaggccgcgtcgaccgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438052 - DNA, 5665 bp, Homo sapiens
tgcctgggggccccgtgcatctttgttcctcgcggccgttgtcgccgcttcgccccgctagtgcccccggccccgggcgctttgtctttcaccgctaccccctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438053 - DNA, 5443 bp, Homo sapiens
ttagaaggaggctcaagatgtatatatgtgtttttctgttagtgtttgagaatagtttcagatagccacaatggatattcatttggcgtgaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438054 - DNA, 6173 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagggtgagaacgcctagtccaagttggccttcagctctttgcagctactctcagctgtgacctggcatcatttcatttcatgggagttttgatttttctccaatcgtctgattaggggatttttatatacaccatttgttgatttaaagaaaaaaaaacaaaattaggaggagcgtacttgccagaaaatttaaatgtaaataaacttgtatgttatcttgaaatgtttttagctagctttgtaataaaaaacattttaattgcccttttttaaaaaaaacaaatgaaagttgaatgagaatctaatttgtgtactttaatgaaaaatgaaaagttttctcagtgttgtgattttctgtgaattgcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438055 - DNA, 5682 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaagagtgacctggaactgggcccactaacttggctgtgacctttatatccttggcctcagtgtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438056 - DNA, 5334 bp, Homo sapiens
aagatggcgcctgttgtggagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438057 - DNA, 5651 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438058 - DNA, 5703 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438059 - DNA, 5003 bp, Homo sapiens
gattggcaaagcaccatgctttagaaagtttataagtttttactgagttatcttcttattaactcttgtctgagggttacttggtaaaattttcttatcctattaatacaaactgtataaaacttagtttctaaacttctttctttattaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagggtgagaacgcctagtccaagttggccttcagctctttgcagctactctcagctgtgacctggcatcatttcatttcatgggagttttgatttttctccaatcgtctgattaggggatttttatatacaccatttgttgatttaaagaaaaaaaaacaaaattaggaggagcgtacttgccagaaaatttaaatgtaaataaacttgtatgttatcttgaaatgtttttagctagctttgtaataaaaaacattttaattgcccttttttaaaaaaaacaaatgaaagttgaatgagaatctaatttgtgtactttaatgaaaaatgaaaagttttctcagtgttgtgattttctgtgaattgcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438060 - DNA, 2121 bp, Homo sapiens
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaagcacaaacaatcacctgcaatgaggtctacctttctgatgtgccccaggaattggaaccctttttccgggcggcagttgaaagggtgggacttagcttctctttggtctgtgcaaattcactataataaagatggcttcggtctgtcctctgaagggtgacgggtgtgc

SEQ ID NO: 438061 - DNA, 4247 bp, Homo sapiens
ggactaggtatgacgagctgggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438062 - DNA, 4092 bp, Homo sapiens
gattgtctgagcatcccactttgctggctgggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438063 - DNA, 1864 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacatagttcagcgttaccggggatggt

SEQ ID NO: 438064 - DNA, 718 bp, Homo sapiens
  misc_feature (633)..(633): n is a, c, g, or t
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaagggaacaacattgggacacaaaaagggtttaatttgtgccccaaantcttccctttgtggttataatcattatggcgcagtggcatgcgaagaaaaaaaagagaacaaatggtgaacgcgatggtgtgtac

SEQ ID NO: 438065 - DNA, 333 bp, Homo sapiens
gtacttgataaaactttttgcatcatccagaggttgtgaggggtgtgggtacaggagattctttcctggcactgattgtaatgtattaaacaaccttgtgttaagtctcatttttaacatgtactttgctttttaaagtgtttttaagtgatttctatttcctcctcaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgc

SEQ ID NO: 438066 - DNA, 656 bp, Homo sapiens
ttgtcatttgcctaatcataaaataaatttaaaaagatgacaatttgatttatttttccacctactgcagtggatgatgatgaatcagaaggagaagaattcacagtccgagatggctacatccattatggacaaacagtcaaacttgtgtgctcagttactggcatggcactcccaagattggtatggctctacttttgctttagtgataatgtgaagtaaaaattaatttcttaaacaggaaaatcacaacattcaaatggaaaaacacacctcagttttatgctttttaattttaaaaggtatgttagtaatcagtgctgtttataattgacagttatgctctaccttatttcagaaatgctttaaggtaatagccagtttttacaagtacattcttaatgattttttcttaaatgatttccaatatattttggtggcaatttcctttttggctgtttatctgaagatgttcagtagagggcactataaattacatttcttttctttactaatgcggataaaccgtattcatttttttgtggtacctgccatatcccaatgtaggaccaagtttgcaaacagaagacattcttatttcttttgaaatataagcgtaatttttgttagcttactctctcacaagaagatagatt

SEQ ID NO: 438067 - DNA, 5807 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438068 - DNA, 5564 bp, Homo sapiens
acaggatcttttcttgcccccgagtcgtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438069 - DNA, 5673 bp, Homo sapiens
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438070 - DNA, 5607 bp, Homo sapiens
acccattgaggaggtgtttcatctaggcctgtgaaacgcagcccattttcccaggacccctcctcccttctcctcggccccgcctcctgacccctccattcctcgtccccgtagtaatcccctccggttttcctcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438071 - DNA, 5409 bp, Homo sapiens
actgttttttcagcagggcgagttaggacggcacaaactgagagtttctgttctggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438072 - DNA, 6056 bp, Homo sapiens
tgcctgggggccccgtgcatctttgttcctcgcggccgttgtcgccgcttcgccccgctagtgcccccggccccgggcgctttgtctttcaccgctaccccctgcgactctctacccccggccctttgtttcgccgccttgggcgctttgtccgacccgtggcgtcccgcatcccctctccatctcctcccctccgctgtccttcctcccgtgcccctttgttgtgccacactcttgtcgttagcccagtgacctgccacagcccgggcaccagatttctgccttaattgttcttccattgtctttctcctgtgggtcccctctcacctttctgtatggtcctggatcaccccccgaggctttgtctcccccatccacgggcttattctctcggcacccccttcctctcccgtcatcggttgatttatccacaacccacggtgtacgtctgctgaactgtctcagccccggggactccatctgctgcttctaagtgcacacaagactctacgtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaagcacaggaaatctggtgaagcggctccacctaaaacgaacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438073 - DNA, 5731 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacagggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggattaagaaaagtaagccattttctgtactaataacagtacaagaagtgagaatgacaatggaggctgtgtgtttcaagaaagaagagaaggaaactacttctttgggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438074 - DNA, 5729 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438075 - DNA, 4778 bp, Homo sapiens
gtttctctatgatgctgcggtcgtgcttgcaatgctcgtctactgtccggactgccgagctccgggggatccgctatggttcgattgctggtgtgcaagctgggcactgtggcgtggtcatgacaccggtcgtggactgtcccaaaccctgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttcagctgttttgttggttggttggttggtttttgtttggttttgtttaaatgggcaagaagtaaataatgtggctggaatacaagttgaacaaactagaagacacaaatctaacatagtttttatggaccaaggaacttgtatattgtataagctttagtaaaaggtacattttcaccatacctttttttatatcacggtattatagtacaccttgttaccaaataggttgttctcttccccacccacctttgagcttttgctctaaaatacattcaggttccaagcctgaccatccttgtttaatctatcatactcttccaggttttttttttttggtctaaggctggaacttttttcttttttttcagctgaagtcttatgacttttcatgagtcaaaattgtttggatttcagcaagtcaaatcttgcaaaggcctgcatattttttttaagattatatgaagtctgtgcaaaagctttaaaaaaatgcctctgccttgcctgcaatacatgcaatgtatgttaacttagtctctcttctcagacactgttggtagttatttctgtgttttcctttttttaaaaaaaaatatggacttattgtggttatctgagaggttctaacattcacatgcaatttggtgtggccatttagctattaatgagttaatggcgcagaacttgttgatatttgaagtgttctctccccttttcccatgacgtaaatacataggtgtgttccaggatttgttcaggtttttcccccctcctaatcttgtacataacttgtattatgtgtaagttaaacattttattttgaacttggaatgttcccagtgatttcattcagcagggtattttctgccttgttggcaagtgacaaaaaatatgggaagtatttgctaccagttggtagatggtgcccttaatggtagaatgaggaaaatgtccgcaaaagcatgttttattatctttacttttttggggggttggagggggtagcctagccagaacatcattgtaatcttaaaacataagatgcttttattagatgatcaactaaaatagctggaagacagtactttagaaacagatagttgtaagattataaaatgcaaatgtaacttatgttttcatttttttctctgccttttttgtttgtttgttttctcttttccagtactgagcatctccacaaatgtctcctaactcagaaaatgtttcttttcttttcagttgagatttggttgcattcagggttgtaggttggccttgcttgctaaccccgccggttttaccgtgctttcattcctgaactttgtttatgcctttgtttggtttcttcgaaattgcagcagactcattgggctacatttagtacaggaaccacgtgtgtaatgttatacaacacagtctagtaatacaatcatccctcttagagtaaaaactacctctagattgtggtaagcttttactgtcccataaaacaggagccacagtaccttatgaatgcaaaactgtaacttcctacagtgtttccctacagaacattgtctttctggtgtcctgggctgttttgaaaaagtttccattaatagactttttagaaattattattagtagcattttttttccagctttgctgtcttcatcactcactctatgctcagactatgccactgtaaatattcttcctaacatctttaaatcgccttttcctcagttttcaaggggaaggtcatttgtaaagcacgttaggtggttaaatcagttattgcggttttctcttactgcaagcctttttaatcacccccaggctgcattttattctatatcgccttttttcttcaaatctgctccaatcactcacttctctcttataagctaatcctgcctcacaccttaaatctgtttcagtgatcaagggcagaactcattgtggccttatctttctttgttgtaattgttcactgtctctttcttacagaccacttatttctgagtagtagttattcctctctatggagtcatggcaggaatcattacacagtgcttttgttcagagcatggacatgttcctagtgctgctttgctttaacggccacaagtttcctccacttcctaggtttggtatttagttaaggaatcatattaaattaaccaataacaaaagagatacttttgaagaacaaactattccttacccatttttgtagctcaaaaataatttttcaagttcatgaccttattaaaatgaacttgtgtttttttaacaaacgtgtatgttttattttgatagtttctttccgtaagataattgaaatattatactgtaaacccttttcttttctttttttgaaaagtccaagaatgtacttatacaggcatttttccccacctatttttggccattctcataccacagactaaagagtgaaatgatttgtccattgtagcttattgtttatcagtagttcttttgtcagctgcttacattttttctttcatggttttgtgaatcattttcagtatgtaatttataggaaccttgtcctctggttatagtagactgtgtgccctcctccagtgatggcattattagacatgctggtcatttaccctcagaaagactctcttattagaatggtgagtgcttcagttatagtatgtttgaatttttaaaaaattctgttttagaaatgtatcttatgctctcatgactatgcagtttctaaacatacacatagaagctgagtctctgatccaatatgtttttatttgttccatttaatttatcacatagattgggaaggcaagctaaaagccttaaaaatgccctttatattttgagtgatttcagcgttgaacactagtatactatctaaatttgctgctcactttctttaaactgtggcaattaaaggcatgtttatacatgacttaatcgtgaaatgtttgtcactcttactgcacagacttatctgcaatcataactggttagtttttttgttttgtttgttttattgtttttaatgaaactggtaccatctgtgctttcacaaaaaacttccaatgccatttttgagaactaacctaactagtcatgctaaccagaaaatccactggggaggaggttccttttgaaacaaaatgctgttcagttagtaaccaagttactttgattgcaaaagcagctgtgtttctgataagtactgaacaaatgtgtgtaattttctgtgccagacttatgactttgttttcaagcactgtaatgtgggatggatggttagaaacaataatatattagggtttctgtttaaccctttcaggactgaactgtatctccttttgttaattttcccctgtgttgtgataaatgtttgccagcattcagtactgtgttggtccagatgtaggtttatatgctcatttttagcttatttcttgtaccttgcagcatgctctacgcattcagtccttaaggggtttattttacaaactgtgcgcctgtaaggtttattagcaataagatagaaaattgagcaagtttataccataattttgtagaaaaaaagaatctgctcagttccatatttcatccgtgaaaaacttgcaatacgagcagtttcaaggaataaataaaaaggaaatgtaaaccatt

SEQ ID NO: 438076 - DNA, 2111 bp, Homo sapiens
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggagaaaaaatgaacaatcgtttgtggtttcttgggaaaacttttcataccaggtgatactattcaaaaaccccgttgtctccctgcaagtgctgatttgaaatgcagaagccacagtaaaaaaaaaaaaaaaaaaaaaaaaaaaagaaaaaaaaatcaaaatgtataaatattggaaatcaagtttttccgggttttttggggggggggggggggttttttttttgttttttttaaaagggggaggaggaaaaaaagggggttggaataaaggtggacaaacttggga

SEQ ID NO: 438077 - DNA, 1916 bp, Homo sapiens
  misc_feature (1865)..(1865): n is a, c, g, or t
  misc_feature (1889)..(1889): n is a, c, g, or t
gtagcgtgagactggactgcccgcattgggtacatgcgcagtgccgctcgcgcgggccgcgccaatcctgcagcgccttcaacaggtttcgggcggcgaattccagttctccgggttttggggctccctgcgggaggcagtgctggatctgggaatctctaggaaaggaaagagcaaaggaggggaaagatggggggctgcagtctccacgtacgtccctcaaagcgcgtcctaaaacccggataaccggagcgctccccatggaccacacggagggctcgcccgcggaggagccgcctgcgcatgctccatcgcctgggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattgataattaggaaagttgataagcagaccgcattattggatgcagatgatcctgtgtcacaactccataaatgtgcattttaccttaaggatacagaaagaatgtatttgtgcctttctcaagaaagaataattcaatttcaggccactccatgtccaaaagaaccaaataaagagatgataaatgatggcgcttcctggacaatcattagcacagataaggcagagtatacattttatgagggaatgggccctgtccttgccccagtcactcctgtgcctgtggtagagagccttcagttgaatggcggtggggacgtagcaatgcttgaacttacaggacagaatttcactccaaatttacgagtgtggtttggggatgtagaagctgaaactatgtacaggtgtggagagagtatgctctgtgtcgtcccagacatttctgcattccgagaaggttggagatgggtccggcaaccagtccaggttccagtaactttggtccgaaatgatggaatcatttattccaccagccttacctttacctacacaccagaaccagggccgcggccacattgcagtgcagcaggagcaatccttcgagccaattcaagccaggtgccccctaacgaatcaaacacaaacagcgagggaagttacacaaacgccagcacaaattcaaccagtgtcacatcatctacagccacagtggtatcctaactaccgtctttttgctaggacttaaactgacttgagtgtggcaaaaagttaacaaaaaaggaaaaaaccatagggacctgtttggttggcttcaggatagcngcttcccaagtgtgaatgaagccngatgaactgtacaggtttgacaacctt

SEQ ID NO: 438078 - DNA, 1652 bp, Homo sapiens
tgtaaaaaaagcaggcggtaccggaccggaaaacccggtaggtttccagggaaggcagcgagcaggatcccctactctgcgggcggcgcgaggcgtctggctcttcgcggcggcggcgaggggaaagggagcgcgggggctgggtggaatcgaggagtgaggaaaaagggaaggggcgggggagagggaccagggaaggcgtcggggggaatctcgcgagggttggagttttggcgagagtttgtggaagatggcgcctgttgtgacaggtcattgaaattatgagactatcattcaaatggaagcattatagttcttcggaaccattatgatctcaaaacgaaaggagaatgatacagatacactggctgaggtgttttgaggtgcatcgaagtgttccaagctgtgacttaccttaacatgttcttgaagtaccatggcgtggattaaaaggaaatttggtgagcggcctccacctaaacgacttactagggaagctatgcgaaattatttaaaagagcgaggggatcaaacagtacttattcttcatgcaaaagttgcacagaagtcatatggaaatgaaaaaaggtttttttgcccacctccttgtgtatatcttatgggcagcggatggaagaaaaaaaaagaacaaatggaacgcgatggttgttctgaacaagagtctcaaccgtgtgcatttattgggataggaaatagtgaccaagaaatgcagcagctaaacttggaaggaaagaactattgcacagccaaaacattgtatatatctgactcagacaagcgaaagcacttcatgttgtctgtaaagatgttctatggcaacagtgatgacattggtgtgttcctcagcaagcggataaaagtcatctccaaaccttccaaaaagaagcagtcattgaaaaatgctgacttatgcattgcctcaggaacaaaggtggctctgtttaatcgactacgatcccagacagttagtaccagatacttgcatgtagaaggaggtaattttcatgccagttcacagcagtggggagccttttttattcatctcttggatgatgatgaatcagaaggagaagaattcacagtccgagatggctacatccattatggacaaacagtcaaacttgtgtgctcagttactggcatggcactcccaagattggtatggctctacttttgctttagtgataatgtgaagtaaaaattaatttcttaaacaggaaaatcacaacattcaaatggaaaaacacacctcagttttatgctttttaattttaaaaggtatgttagtaatcagtgctgtttataattgacagttatgctctaccttatttcagaaatgctttaaggtaatagccagtttttacaagtacattcttaatgattttttcttaaatgatttccaatatattttggtggcaatttcctttttggctgtttatctgaagatgttcagtagagggcactataaattacatttcttttctttactaatgcggataaaccgtattcatttttttgtggtacctgccatatcccaatgtaggaccaagtttgcaaacagaagacattcttatttcttttgaaatataagcgtaatttttgttagcttactctctcacaagaagatagat

SEQ ID NO: 438079 - DNA, 1194 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438080 - DNA, 1152 bp, Homo sapiens
  misc_feature (1096)..(1096): n is a, c, g, or t
  misc_feature (1100)..(1100): n is a, c, g, or t
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaattacaatgtggagccaaaatntcgnttcggtcggattcctttttaaaacaggtttgaaaaatgtggccaacaaaagc

SEQ ID NO: 438081 - DNA, 988 bp, Homo sapiens
  misc_feature (872)..(872): n is a, c, g, or t
  misc_feature (967)..(967): n is a, c, g, or t
  misc_feature (988)..(988): n is a, c, g, or t
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagaatgaacttggaaaaagaaactttttanccttaaaaatccttcccagtttacatttggtccttactcctcctttttaactttcctcaagaacaacttccccccccacccctccattaaaaaanccttgtttggccattgccaan

SEQ ID NO: 438082 - DNA, 444 bp, Homo sapiens
ccccccagccagaccgacccagcagcagcacctcaggtcagcctgggtgcccctgcccagtggccactgtgacctgcagacaccaggaggccaggcctggttgctggggacccccttggggggcccggcagtatcctaggcccaaagagctggtgccatcttgaagctgattcagggaagaggccaggctggacggtaggggtaggtgtgagaagctccccagcgtgtccaggccacgggagcagcaagggtctgcggggagcccaggctggatgggccccccagccacgggccccccaccctcatagaacctgttgcatgcaacttagtttcacagctttgcctcttctttttgatgtatttattccagacctttctgccacttagcacttgtataatcagactggaaatggggatggggctgctggctcggcgggggtaccg

SEQ ID NO: 438083 - DNA, 236 bp, Homo sapiens
ggcagaaaggtctggaataaatacatcaaaaagaagaggcaaagctgtgaaactaagttgcatgcaacaggttctatgaggagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438084 - DNA, 1424 bp, Homo sapiens
  misc_feature (1240)..(1241): n is a, c, g, or t
  misc_feature (1243)..(1243): n is a, c, g, or t
  misc_feature (1388)..(1388): n is a, c, g, or t
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaaaaaaaaaaaaaaaaactcgagttttttttttttttttttttttttnntntgtccaaaactcttctttatttcaagatgatgtttctgtggctatgtgtggtatgtggtataaatctcaatctatggtcacacgaggggcattttccttgttgtaagtgtagtctaacccagtaggaaggaggtttaattgccanaacagccctcgtgccgaatttcctgcagcccggggg

SEQ ID NO: 438085 - DNA, 1337 bp, Homo sapiens
  misc_feature (375)..(375): n is a, c, g, or t
  misc_feature (427)..(427): n is a, c, g, or t
gctccgtacccccgcgcccccctcccgtcgcgcgcctgctggccggacccctgccccaggtctggccagtgcggctggcaggacctgtcagactggctgagaaggaggcgcggggccggaggtggagggaggagggttgctggcgaggccctggcccggacgtccagggccgggaggctccagtcgatggagccggtctggggagacgccctgctggagaagtggccgggtcccggccgtgcgttggccggccctgcgccacctgggtgacctcagacacctgggccttggacggcccggctgcccggcggccaacgctgccctcccggcgccgcggcgggtcctggcggtggattggggccgacccgggcgtgntcgtgtggagcacctgccctgtgcccaacactatcctagatgctttggaggntggaggagcctcctgttgcacggtcttgcctaagaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438086 - DNA, 1140 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcatgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438087 - DNA, 1100 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatctcagtggtgtgggtggtgtggactcaggtggtgtggactcaggtggtgtgggtgcgagtca

SEQ ID NO: 438088 - DNA, 1102 bp, Homo sapiens
  misc_feature (1053)..(1053): n is a, c, g, or t
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatagagtggtatagagnggtatagtggtggtatagggtggtatagctagtggtatggtggtatcag

SEQ ID NO: 438089 - DNA, 895 bp, Homo sapiens
ccagacctacctaatcctaaaatgcgagtttttatttttaataactgtaccaaggaataagtatgaaaacagttctctgttaccatattttgtattctggaccacttactggtgaaagcaaccatgcaaaagaaattaatttggccaggcacagtggctcatgcctgtaatcccagcactttgagaggccacagtgggtagatcatccgcaagcagggggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438090 - DNA, 1004 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttgagaggtagggtaagagctc

SEQ ID NO: 438091 - DNA, 639 bp, Homo sapiens
ctaagtcctgcggagatactgtgcatgatgatgagccggccacaatcacagtctgacatgtgtgagagtaatgccagatctgagaatgttagaaaagcctttgtgcgttgatgaagaagcacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438092 - DNA, 870 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaaagttcagagccagggggtaccgagctc

SEQ ID NO: 438093 - DNA, 514 bp, Homo sapiens
ggactctagaggatcccctgctgactatttgttgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438094 - DNA, 613 bp, Homo sapiens
ggggatcggtttacagatgaggaagtggatgagctgtacagagaagcacctattgacaaaaggggaatttcaattacatcgagttcacacgcatcctgaaacatggagccaaagacaaagatgactgaaagtgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438095 - DNA, 1088 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggggagaagatggcgtcccatcagttagggtggggcaggaacaaatcacaatgttggaatgtcatcagttaaggctgtttttacttcttttgtggatcttcagttactttaggccatctggatgtatacgtgcaagtcacaggggatgcgatggcctggcctgggctcagaggcctgacattcctgccttcttatattaataagacaaataaaacaaaatagtgttgaagtgttggggcagcgaaaattttaggggggtggtatggagagataatgggcgatgtttctcagggctgcttcaagcgggattaggggcggcgtgggagcctagagtgggagagatgg

SEQ ID NO: 438096 - DNA, 705 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438097 - DNA, 1570 bp, Homo sapiens
  misc_feature (1222)..(1222): n is a, c, g, or t
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaaaaaaaaaaaacaaaaaaaaaaaaaaaanaaaaaaaaaaaaaaaaaaaaaaaaaaaaaaaaaaaaaaaaaaaaaaaaaaaagaggaggggggcgggcgccccaaaaaacccccccgggggggcgcccataagccagagacgaaccccacccattttgataagaacaagaggggccccccaaagaggagagagggccttatctattaaaccagacacgaaacggagggcagcgcatcataaaacaaagacacacggggggggaaaaaaacgcgagtggcgggaaaaacgtggggaaagacaaaccccaacacggggggggggacgaacaagaggcgaaaaacccaccacgagaaaaaatacaccacacaagaacaaaa

SEQ ID NO: 438098 - DNA, 1146 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaacaaattccagccaaacgttccttgttgccactttgggtattctgagattttctcttgcatgcccttagctttacagcttttgcatttcctgttgtatttattctcagccattttgggcatatgtatctttataatcagactggaaacgggactttctattaatatcattttcagaataaaaaataggataatttaacctaccagcccttctcccccaataactgtggtctatacagagtcaatatattttttcagagaaagttattcgctcgattttttctgaatcataattaaactttatgat

SEQ ID NO: 438099 - DNA, 1326 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggtttgcgatttacctttttattataaatgttttgaataagatttctgatcagaaaaaaaaagggggggctaaattcccaggggcagttagttcccttttgcaaggcgcagggcgttaaaagcggcggtaaaggggaagatgtttgggacttgggtaggaccagaaacggaaaattttgactgtggtgtattatataacgccactaac

SEQ ID NO: 438100 - DNA, 1365 bp, Homo sapiens
  misc_feature (375)..(375): n is a, c, g, or t
  misc_feature (427)..(427): n is a, c, g, or t
gctccgtacccccgcgcccccctcccgtcgcgcgcctgctggccggacccctgccccaggtctggccagtgcggctggcaggacctgtcagactggctgagaaggaggcgcggggccggaggtggagggaggagggttgctggcgaggccctggcccggacgtccagggccgggaggctccagtcgatggagccggtctggggagacgccctgctggagaagtggccgggtcccggccgtgcgttggccggccctgcgccacctgggtgacctcagacacctgggccttggacggcccggctgcccggcggccaacgctgccctcccggcgccgcggcgggtcctggcggtggattggggccgacccgggcgtgntcgtgtggagcacctgccctgtgcccaacactatcctagatgctttggaggntggaggagcctcctgttgcacggtcttgcctaaggtgaagcctccgaggaagccattagcataattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438101 - DNA, 1075 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggattttcggttttaaaacagaggttctctcgggcagtctc

SEQ ID NO: 438102 - DNA, 829 bp, Homo sapiens
cttgtggcgacaaatcctgatggggcagcatacaatgggcctgccatgtgggagcactttgcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438103 - DNA, 1118 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgacaaaaaggggaatttcaattacatcgagttcacacgcatcctgaaacatggagccaaagacaacaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438104 - DNA, 1131 bp, Homo sapiens
cgcagcgcaggccgcgatatcgcagcggatcggagcaggccggaggggcaattaagaccccggccgtgtgcgtccggcctcagcagccccgccgctcggcggacacgcagaccccgccggcccgggcgcgaacactcagcgcacccccgttccactggtcccgccgcgccttccggtgcgccagcggcggtgcgccttccgctccgccccttcaggcaggaagtgtcggcgccgccactgtccggccacagcctaacgctcttcgctgtcgtttgcggtctcgcgcagggcggccccggttctggtgtttggcgtcggaattaaacaaccaccatgtcgagcaaaaaggcaaagaccaagaccaccaagaagcgccctcagcgtgcaacatccaatgtgtttgccatgtttgaccagtcacagattcaggagttcaaagaggccttcaacatgattgatcagaacagagatggcttcatcgacaaggaagatttgcatgatatgcttgcttctctagggaagaatcccactgatgcataccttgatgccatgatgaatgaggccccagggcccatcaatttcaccatgttcctgaccatgtttggtgagaagttaaatggcacagatcctgaagatgtcatcagaaacgcctttgcttgctttgatgaagaagcaacaggcaccattcaggaagattacctaagagagctgctgacaaccatgggggatcggtttacagatgaggaagtggatgagctgtacagagaagcacctattgaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438105 - DNA, 571 bp, Homo sapiens
taatggcaccatgaatttaccgcaattttacattacgaactccatcttattagggaaatttctgccctccgaggcacaagatattccggccacgaggcgtgcacgtagggggcagggtaagcaagtggatgagctgtacagagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaagattatgctgactcaaatgcaa

SEQ ID NO: 438106 - DNA, 2472 bp, Homo sapiens
agaccttcccctccctatccccaactttaaaggtgtgagagtattaggaaacatgagcagcatatggcttttgatcagtttttcagtggcagcatccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcccaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacaccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggc

SEQ ID NO: 438107 - DNA, 3001 bp, Homo sapiens
ttatcctcattttctgaaccccaggcctgaggccaggccagctggggcctggcttccaggagctggacttgctcctgtctccattggtgcagactttggttccaggtgaagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcccaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacaccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggc

SEQ ID NO: 438108 - DNA, 1897 bp, Homo sapiens
agaccttcccctccctatccccaactttaaaggtgtgagagtattaggaaacatgagcagcatatggcttttgatcagtttttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatcccttccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacaccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggc

SEQ ID NO: 438109 - DNA, 4003 bp, Homo sapiens
gcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcccaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacaccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggc

SEQ ID NO: 438110 - DNA, 2110 bp, Homo sapiens
gcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggc

SEQ ID NO: 438111 - DNA, 482 bp, Homo sapiens
tttacagggtctctagttctgtgtaaattaaatatgctgatcattgcaacacggtctctcatgagagaccgtgttgcaaatgggtacgcccaagcccatgccagtgtctagatcatactgctagcaagtgatggagcgcgacttagaaggaagcggttctcttaacctctgtgccatattgccttctgattacaagaaccttgcagatcctgttctctccagcccccgacctgccttcctagcctctcattctgttattgcatctgacaaacacagcccaatactcaatccagtctgagttgctgcgcaattccttaacgctctaggcttctgggcttcctctggttgcattcctaaacataactgacaaacttctccccatccttcaaggcccaacttaaatgtcacaccaataaaacctttccagattccccgaagcattgtcatgcctttctttttgccctcgggttttttcctaatta

SEQ ID NO: 438112 - DNA, 410 bp, Homo sapiens
ccatgaggaaaggaaccacgtcctaagcctctgtaatccccaatactagcagggtacccagcacaaagtgggtactcagtagattccttttggcggagtagaggacagtaaaaattcctggtcaggcgcagtggctcatgcctataatcccagcactttgggaggctaaggtgggaggatcacttgagcccaggacttcaagaacagcctaggcaacatagtaagacctcatctctactaaaaatttaaaaattagccaggcatggtagcatgcacatgcagtctcaactacttggggggctgaggcaagaggattgcttgagcccaggagtttgaggttgcagtgagctgtgatcacaccaccgcactccagcctgagtgttaaaacaagaccttgtcgcaaaaaaaaa

SEQ ID NO: 438113 - DNA, 277 bp, Homo sapiens
atgagctgcacgctgccctaactgactgatacccactcagtcatttaagccgtataagaaaaaaactattttcccatgttgcaaatgggtacgcccaagcccatgccagtgtctagatcatactgctagcaagtgatggagcgcgacttagaaggaagcggttctcttaacctctgtgccatattgccttctgattacaagaacgttgcagtgagctgtgatcacaccaccgcactccagcctgagtgttaaaacaagaccttgtcgcaaaaaaaaa

SEQ ID NO: 438114 - DNA, 583 bp, Homo sapiens
agtgtaaaatatattgatggctgtaaagggacaacttggggatattttaggtctgctgagatgatgcacagcatacatacatgctctagtttttggaacaatgtcattaagttttcaaatacatctgttttgaacatggtattttgtttttctcattagcacgaattactactctacagtttcttctagagtaaataaatataatggctgtttgcagagcgactacagacttacttagatgtttaacaaggtgaacgatttcacaattagatcaaccattgagttaacagcaaggtgtttttcatctgttttgtttactgctatagtggggacaggtaacttctccaatttattctttgttgacatctttagttaccaacagactcccaaaagtaatgaaaagtcgattaaaaagaaaattgtaattatgccatgggttttcccaagatccttaaagtcagctcatttaaatttacaagagaaaaataacaggcatcatggaaaactaagtaacaaaaagctattgaaaaatacatctgtggaacacagtggtcagttgtaaacagctcagaagagcaaaaaa

SEQ ID NO: 438115 - DNA, 537 bp, Homo sapiens
ttcgtgtagaagaaagggaccgaaaaaaaaaataatattattttttgagacaatgtcgaaaaatatccaaaaaaactatatttttgacaaagagtaatgtatttatcaataaggcacaataacaactaaccagtttcttctagagtaaataaatataatggctgtttgcagagcgactacagacttacttagatgtttaacaaggtgaacgatttcacaattagatcaaccattgagttaacagcaaggtgtttttcatctgttttgtttactgctatagtggggacaggtaacttctccaatttattctttgttgacatctttagttaccaacagactcccaaaagtaatgaaaagtcgattaaaaagaaaattgtaattatgccatgggttttcccaagatccttaaagtcagctcatttaaatttacaagagaaaaataacaggcatcatggaaaactaagtaacaaaaagctattgaaaaatacatctgtggaacacagtggtcagttgtaaacagctcagaagagcaaaaaa

SEQ ID NO: 438116 - DNA, 270 bp, Homo sapiens
ggaggaggtcaacagcgaccacattaacaacagtgaaacccgtcattcacacggagaaaacatccgcatgtgcagtcatcgcgatctcgtaatacatcatattcttctaacatgtctaaataacccgagccacttacaattactaaatgcccctacccctccttctaactttattgctgtattctcttcactctatatttctctctatttgctaatattgcattgctgttacaataaaaattcaataaagatttagtggttaagtgcaaa

SEQ ID NO: 438117 - DNA, 6266 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438118 - DNA, 6212 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438119 - DNA, 3487 bp, Homo sapiens
aaaatagtgactattttgaagtatgctatgttaattcttactttgggagtctgaaaataaattgcatttttttccctaaaacttagaattcactcctttcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438120 - DNA, 6158 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaagtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438121 - DNA, 6479 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaaaaaaaaagagaaagaaaaaaaaaatttgtggggggcggggcggaaaaagccttcaacaccagtcgttgtgggacgggggccccaaaaggtgtgagcgaaaacaaagtggccacagcatgcccacaaagagaacaccggggacagacacaagggggaggattccagacaagaaaaaaagccgcgggggtcaaggaagggttcggaaaaaacccaaaggaggtgagagacacaagggctctgacagaagagcaaggagcgcaatcaatc

SEQ ID NO: 438122 - DNA, 5733 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaagcgcctcgggtagaccgaagtcctcgggggtcaatggtgacggcttgacgggcgcggaacagctgcctcatacctcggaacactgagcggttgacaaaccaacggggggggacacacaagggggcgggggactcatatagaacagaggaaggacaacctctaaacaaagaggtgtccgcccgtcta

SEQ ID NO: 438123 - DNA, 5367 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggaggggtggaataatccataagaaaaagttttaaaaatattggaaaagaaccctagtgatgaaaatttgagagacccttatactataatttggt

SEQ ID NO: 438124 - DNA, 1127 bp, Homo sapiens
atattgaaacacagaaagtttacatatcctagcatgataaatttagctagttctctctaggcttgcctatcaatgggagctctagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438125 - DNA, 1029 bp, Homo sapiens
atcattagtcatggtgtgtctctagtgaagatccgtggctcatgacgtagtgcgttggatttctcaccaatagaaaacgcccgggggtcaacctgatgcgttcttgtacaaagtcccgtattggagtttctgaggtcatgtacgtggatctattcatctggtagtccaaggcgagtctcggatatcaatttacgccccgtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438126 - DNA, 601 bp, Homo sapiens
gcacttaaccactaaatctttattgaatttttattgtaacagccatgcaatattagccaatagagagaaatatagagtgaagagaatacagcattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438127 - DNA, 3899 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaagaagatcttggacagcgtgggtatcgaggcggacgacgaccggctcaacaaggttatcagtgagctgaatggaaaaaacattgaagacgtcattgcccagggtattggcaagcttgccagtgtacctgctggtgggctgtagccgtctctgctgccccaggctctcgagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatca

SEQ ID NO: 438128 - DNA, 6574 bp, Homo sapiens
gtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438129 - DNA, 7373 bp, Homo sapiens
aaaaaagtaaatgtctttaggtgggaaatgcatgcccatgttgctatagttgcagcccctccctcttttaatcccactctttttacacagatagtcacctttctattttctaattaataactttgttcatatcagctaaccattgttgaatactcactacataatttacctgcactatttaattaagtcctcataattagtttgaggtatactattattgggcttctttgaatgtcccattttatagcttttcctaggaggcatcaattattatttcttgaatgactgcataatgacaaaggaaactgacatacacatattgctgcttagtgccatttctgtcccatagagaattttctttggggatttaaattatggtcagaaaagtaatttaggcagtcctgtggtttttgtggtggtggttgtttgatttgataaccagttaccttctcggtggcagtggaatagggttgtgacagttggccagagtaccctcctgcccacagggctgatgaatacatgcattgtgattttaatactcccttcttgctttaatgagattctattagttgcagtattaactatttttggcctggcttctttaataacaaaagttattattttggctttaatttgcataattgattttgtatccatgtttgccttgaagtttcttgctgtgtttgaatacaaaactacttgtttagagggtttcaacattcttttatagtttataaaggtaagcatgctgttgataatgtattgttgaatcataatgaacaggtggcctttgaggaagacaaggtcatttgaacatcaaaaagtactttgctttttgttatatatggtgctgattactaactttctcttgagagtttattttctttgttcactaattattaatgtaagcacgtagagcaagggataatttaaataccaaatcctttgtgtctgcttttgctgctttgaatgtataagttggatttatacatacatttatctttatttacagaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438130 - DNA, 6159 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattactttctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438131 - DNA, 6396 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaaaaaaagaagcaaacaaacaattgtgggcgcccaccccgagaaaatttttgaaacaatgttgtgggcggccaagattggacacgaggcaaggttcccggaaactggcgaagaggtgtgtctcacaaaaaaaacgggccacggttgaaaactagggtgggcaatggatacaagacgacttatacgg

SEQ ID NO: 438132 - DNA, 6342 bp, Homo sapiens
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatccgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaatatgcccctacccctccttctaactttattgctgtattctcttcactctatatttctctctatttgctaatattgcattgctgttacaataaaaattcaataaagatttagtggttaagtgcaaaaaaaagaagcaaacaaacaattgtgggcgcccaccccgagaaaatttttgaaacaatgttgtgggcggccaagattggacacgaggcaaggttcccggaaactggcgaagaggtgtgtctcacaaaaaaaacgggccacggttgaaaactagggtgggcaatggatacaagacgacttatacgg

SEQ ID NO: 438133 - DNA, 2917 bp, Homo sapiens
gtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaa

SEQ ID NO: 438134 - DNA, 3953 bp, Homo sapiens
  misc_feature (3888)..(3888): n is a, c, g, or t
  misc_feature (3941)..(3941): n is a, c, g, or t
atgaagatgttactcctgctgcattgccttggggtgtttctgtcctgttctggacacatccaggatgagcacccccaatatcacagccctccggatgtggtgattcctgtgaggataactggcaccaccagaggcatgacacctccaggctggctctcctatatcctgccctttggaggccagaaacacattatccacataaaggtcaagaagcttttgttttccaaacacctccctgtgttcacctacacagaccagggtgctatccttgaggaccagccatttgtccagaataactgctactatcatggttatgtggaaggggacccagaatccctggtttccctcagtacctgttttgggggttttcaaggaatattacagataaatgactttgcttatgaaatcaagcccctagcattttctaccacgtttgaacatctggtatacaagatggacagtgaggagaaacaattttcaaccatgagatccggatttatgcaaaatgaaataacatgccgaatggaatttgaagaaattgataattccactcagaagcaaagttcttatgtgggctggtggatccattttaggattgttgaaattgtagtcgtcattgataattatctgtacattcgttatgaaaggaacgactcaaagttgctggaggatctatatgttattgttaatatagtggattccattttggatgtcattggtgttaaggtgttattatttggtttggagatctggaccaataaaaacctcattgtagtagatgatgtaaggaaatctgtgcacctgtattgcaagtggaagtcggagaacattacgccccggatgcaacatgacacctcacatcttttcacaactctaggattaagagggttaagtggcataggagcttttagaggaatgtgtacaccacaccgtagttgtgcaattgttactttcatgaacaaaactttgggcactttttcaattgcagtggctcatcatctaggtcataatttgggcatgaaccatgatgaggatacatgtcgttgttcacaacctagatgcataatgcatgaaggcaacccaccaataactaaatttagcaattgtagttatggtgatttttgggaatatactgtagagaggacaaagtgtttgcttgaaacagtacacacaaaggacatctttaatgtgaagcgctgtgggaatggtgttgttgaagaaggagaagagtgtgactgtggacctttaaagcattgtgcaaaagatccctgctgtctgtcaaattgcactctgactgatggttctacttgtgcttttgggctttgttgcaaagactgcaagttcctaccatcagggaaagtgtgtagaaaggaggtcaatgaatgtgatcttccagagtggtgcaatggtacttcccataagtgcccagatgacttttatgtggaagatggaattccctgtaaggagaggggctactgctatgaaaagagctgtcatgaccgcaatgaacagtgtaggaggatttttggtgcaggcgcaaatactgcaagtgagacttgctacaaagaattgaacaccttaggtgaccgtgttggtcactgtggtatcaaaaatgctacatatataaagtgtaatatctcagatgtccagtgtggaagaattcagtgtgagaatgtgacagaaattcccaatatgagtgatcatactactgtgcattgggctcgcttcaatgacataatgtgctggagtactgattaccatttggggatgaagggacctgatattggtgaagtgaaagatggaacagagtgtgggatagatcatatatgcatccacaggcactgtgtccatataaccatcttgaatagtaattgctcacctgcattttgtaacaagaggggcatctgcaacaataaacatcactgccattgcaattatctgtgggaccctcccaactgcctgataaaaggctatggaggtagtgttgacagtggtccaccccctaagagaaagaagaaaaagaagttctgttatctgtgtatattgttgcttattgttttgtttattttattatgttgtctttatcgactttgtaaaaaaagtaaaccaataaaaaagcagcaagatgttcaaactccatctgcaaaagaagaggaaaaaattcagcgtcgacctcatgagttacctccccagagtcaaccttgggtgatgccttcccagagtcaacctcctgtgacgccttcccagagtcatcctcaggtgatgccttcccagagtcaacctcctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaaaataattaataagtttactttccagccagtcctggaagtctgggttttacctgccaaagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactcctcttcatgtcaggcaatttgagatatacaccatgttgttttctactgctcaaactgtgctttggcaattaaagcctgcctctnacatctctgtgtgtggcagcaaaatggagtctcagcaaccagcaggaaaatancaggaccgagct

SEQ ID NO: 438135 - DNA, 2800 bp, Homo sapiens
ttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgttttttttttttttggtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatatatttttggtttgaagactttgtctaagcctcattatactgaagttgaagaaaccaaatgagctccaccctcactttgcctgccctgatatggtcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaa

SEQ ID NO: 438136 - DNA, 3254 bp, Homo sapiens
ttttattagtatgtttcaaatgtgtattaccaatgtgggtgtaaatttttaaaaaatgattattgatagaagtttggcaggaaaattctttaagagctaacaagagaagagagtccagttttctggaaatatgtctttaagtattttagacattcctcgtcagtattaggaatttccatgggaaaagaggtttgcatgctggtaatgcaacctttgaaactttgtaaaggaaacatatatgtatatatttatgtatatgtaagtatgtgaatgtgcgcattttgcattccatatgaaaaaaatgccacgtctgtttaaattatttgatgtaggtttgggtttttgagatttgctggtgaagtcagtgacgaaaaataaaccttcccttatcttcctactctgcccctccccctaatgaaatcatattaagttgttttttttttttttggtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatatatttttggtttgaagactttgtctaagcctcattatactgaagttgaagaaaccaaatgagctccaccctcactttgcctgccctgatatggtcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaaaaaaaaaaaaaaaaaaaaaaaaaaaaaaaaaaaaaaaaaagaaaaaaaaagaaaacaaaaaaaaacaaaaaacagaaaaggatacaaaaaaaaaaagatatacaagaaaagacatagcaaagaagacagaaacacaagccatataggagaatagaacagataagaagggcgaccgagtccaatacaatgccaacctctgcgcaaaacaactccatccagtcatcgttgcatgaaatctgagtagggcaaggtagatggcgtgcaacacacgtccccaccacctcaaacgccgaaccaagcgaatacgcactccctataaggggttaaaaagacgccagttgacgtcgaactaacaaagaccaatcgatgcgtggatgaggaatacggcgaccagaaagactcatgtccgtgcgctaatcatagagttgagggcaaaagccacgcgtgggagcac

SEQ ID NO: 438137 - DNA, 2120 bp, Homo sapiens
aataatagcagtaattctgtaataaacatgtctctatgaatccattagtccatattttgtaaactctggctttgagaacctgtaatacttgatatatttttggtttgaagactttgtctaagcctcattatactgaagttgaagaaaccaaatgagctccaccctcactttgcctgccctgatatggtcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaa

SEQ ID NO: 438138 - DNA, 2770 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438139 - DNA, 2716 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagcgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438140 - DNA, 2824 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtt

SEQ ID NO: 438141 - DNA, 2718 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagtggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438142 - DNA, 3172 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaaaaaaaaaaaaagtgtgtggtggggcggccgtgggccttgggaaaaggttttttggagaacccttgctgggtggggggcgggggccccccagttgggtttagtgtgtgaaccgtgggccaaagagggggtggcccccaaaggagaagctcccggggggcctagagaagctatgtaggtgggctgtggttgttctccccccccaaatttaataaaaaagcgccgcgggggggaaccaccggggggttttttccgtgggcacaactctccccagaagaggggggaggttcccggaggggcccaacaagccggcggtctctcccaaaggggggggtcccaagggagagctctagaaataaaattacgaggggggtggggaggaggagac

SEQ ID NO: 438143 - DNA, 890 bp, Homo sapiens
tagtcccacacctgcaccggtagccccacacctgcaccggtagtcccacacctgcaccggtagtcccacacctgcaccggtagttccacacctgcaccggtagtcccacacctgcaccggtagtcccacacctgcaccggacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438144 - DNA, 659 bp, Homo sapiens
gctgccgcctactactactaaattcgcggccgctcgagcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438145 - DNA, 2141 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatccagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtt

SEQ ID NO: 438146 - DNA, 1751 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgctgcttcggaacaggtcggagcacagctcctcgaacctcgtcctgctgatgacgtgtagaagtcgacgccctcaaacagggagtcgatcgtccagg

SEQ ID NO: 438147 - DNA, 1595 bp, Homo sapiens
  misc_feature (1564)..(1564): n is a, c, g, or t
  misc_feature (1579)..(1579): n is a, c, g, or t
  misc_feature (1581)..(1581): n is a, c, g, or t
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaagacactgacccatcggggatcanctagagtcggcctgnangaagggcaaacaaa

SEQ ID NO: 438148 - DNA, 385 bp, Homo sapiens
  misc_feature (139)..(139): n is a, c, g, or t
caatttttactgtgcctttgtttttactagtgtctgctgttgcaaaaagaagaaaacattctctgcctgagttttaatttttgtccaaagttaattttaatctatacaattatttccttttgcctatcaaaaaaaaaanattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438149 - DNA, 1324 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaaaaaaaaaaaaaaaaaaagtgtgtggtggggcggccgtgggccttgggaaaaggttttttggagaacccttgctgggtggggggcgggggccccccagttgggtttagtgtgtgaaccgtgggccaaagagggggtggcccccaaaggagaagctcccggggggcctagagaagctatgtaggtgggctgtggttgttctccccccccaaatttaataaaaaagcgccgcgggggggaaccaccggggggttttttccgtgggcacaactctccccagaagaggggggaggttcccggaggggcccaacaagccggcggtctctcccaaaggggggggtcccaagggagagctctagaaataaaattacgaggggggtggggaggaggagac

SEQ ID NO: 438150 - DNA, 518 bp, Homo sapiens
gctgccgcctactactactaaattcgcggccgctcgaaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438151 - DNA, 2652 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438152 - DNA, 2485 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggcaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438153 - DNA, 3252 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaaaaaaaaaaaagaaaaagagacgccaagcacaaaacacagcgaggaacagacgaaacaagcgggggggggggcagaaaaccccggagggggcgcaacggggcaccacaattgagacaagaggccccaaagaggagcacaataaggacgaagaggggcagaaaaaacaacgcagagggagaaagatccacggacctcgggagagaccaacagggggggacaagtggaccacaccagcgaataaaccccccggaggaaaaacacgggggagggaggcacacagccaatctgcggccgcgaacggctcggggaatttaatatgcagggaacgaagacagcacgacaacagacgcccccagccaagcaagagccacacgaagaccgaccagagaccaacacagcccgccagaaccggcgacacaccacaccaccgcgtgacaccccgcgcagcaagaccagcaacacaaccgcagcacagaaagaa

SEQ ID NO: 438154 - DNA, 2556 bp, Homo sapiens
  misc_feature (2374)..(2374): n is a, c, g, or t
  misc_feature (2386)..(2387): n is a, c, g, or t
  misc_feature (2520)..(2520): n is a, c, g, or t
  misc_feature (2522)..(2522): n is a, c, g, or t
  misc_feature (2531)..(2531): n is a, c, g, or t
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctggggctggagacggccggaggcgtgatgactgccctgatcaagcgcaactccaccatccccaccaagcagacgcagatcttcaccacctactccgacaaccaacccggggtgctgatccaggtgtacgagggcgagagggccatgacgaaagacaacaatctgttggggcgcttcgagctgagcggcatccctccggcccccaggggcgtgccccagatcgaggtgaccttcgacatcgatgccaacggcatcctgaacgtcacggccacggacaagagcaccggcaaggccaacaagatcaccatcaccaacgacaagggccgcctgagcaaggaggagatcgagcgcatggtgcaggaggcggagaagtacaaagcggaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggngggaggagaggnnttcctctcctcccacctcgtaggaagacatcagacaatattatatgatatgttagaaggtttgtgtgaatgcatttattatatgtgtttctctggctacttacagcagcataggggcaggctggagtgggtangngctagattntactaggacgtataatggggcgagg

SEQ ID NO: 438155 - DNA, 629 bp, Homo sapiens
tgatctagaggatcccatctcaggccaggacgaggtgcagcgcgagagggtgtcagccaagaacgccctggagtcctacgccttcaacatgaagagcgccgtggaggatgaggggctcaagggcaagatcagcgaggccgacaagaagaaggtgctggacaagtgtcaagaggtcatctcgtggctggacgccaacaccttggccgagaaggacgagtttgagcacaagaggaaggagctggagcaggtgtgtaaccccatcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattca

SEQ ID NO: 438156 - DNA, 1928 bp, Homo sapiens
tgcccacaactgcgcaggcccagcaagcccccacaattaaaagcccagcgccgacccttcctgtcaattaggcgctgaagcgcaggcggtcagcatcgccatggagaccaacacccttcccaccgccactcccccttcctctcagggtccctgtcccctccagtgaatcccagaagactctggagagttctgagcagggggcggcactctggcctctgattggtccaaggaaggctggggggcaggacgggaggcgaaacccctggaatattcccgacctggcagcctcatcgagctcggtgattggctcagaagggaaaaggcgggtctccgtgacgacttataaaagcccaggggcaagcggtccggataacggctagcctgaggagctgctgcgacagtccactacctttttcgagagtgactcccgttgtcccaaggcttcccagagcgaacctgtgcggctgcaggcaccggcgcgtcgagtttccggcgtccggaaggaccgagctcttctcgcggatccagtgttccgtttccagcccccaatctcagagcggagccgacagagagcagggaaccggcatggccaaagccgcggcgatcggcatcgacctgggcaccacctactcctgcgtgggggtgttccaacacggcaaggtggagatcatcgccaacgaccagggcaaccgcaccacccccagctacgtggccttcacggacaccgagcggctcatcggggatgcggccaagaaccaggtggcgctgaacccgcagaacaccgtgtttgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatggtgctgaccaagatgaaggagatcgccgaggcgtacctgggctacccggtgaccaacgcggtgatcaccgtgccggcctacttcaacgactcgcagcgccaggccaccaaggatgcgggtgtgatcgcggggctcaacgtgctgcggatcatcaacgagcccacggccgccgccatcgcctacggcctggacagaacgggcaagggggagcgcaacgtgctcatctttgacctgggcgggggcaccttcgacgtgtccatcctgacgatcgacgacggcatcttcgaggtgaaggccacggccggggacacccacctgggtggggaggactttgacaacaggctggtgaaccacttcgtggaggagttcaagagaaaacacaagaaggacatcagccagaacaagcgagccgtgaggcggctgcgcaccgcctgcgagagggccaagaggaccctgtcgtccagcacccaggccagcctggagatcgactccctgtttgagggcatcgacttctacacgtccatcaccagggcgaggttcgaggagctgtgctccgacctgttccgaagcaccctggagcccgtggagaaggctctgcgcgacgccaagctggacaaggcccagattcacgacctggtcctggtcgggggctccacccgcatccccaaggtgcagaagctgctgcaggacttcttcaacgggcgcgacctgaacaagagcatcaaccccgacgaggctgtggcctacggggcggcggtgcaggcggccatcctgatgggggacaagtccgagaacgtgcaggacctgctgctgctggacgtggctcccctgtcgctgggggcttggaaggacgggccggaagggccgtgaatggactttggccccttggaattcaaggcgccaaattcccaaccaaatcccccacacaaaggcaaggaacgccagaattctttcaacccaacctaaattcccggaaa

SEQ ID NO: 438157 - DNA, 4331 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggagggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438158 - DNA, 4454 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438159 - DNA, 4400 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcccaccgctgatgtgacaggaggcggagctcgggctcccactgagtctctgtgatcgtgggaagtaaggaccagctat

SEQ ID NO: 438160 - DNA, 2697 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctctgctcccaggtcaaagtgaatctgcccactcggctccgatagcgggatacaggtgcc

SEQ ID NO: 438161 - DNA, 262 bp, Homo sapiens
tgttggccaaggcaggtggatcacttgaggccagaatttgagaccagcctggccaacatggcgaaaccctgtatcactcttttaggcccttctgagtgtttgcaggctgagtgttcacagggtgttagcctattgagctttcttttgtggttcttacgcaggagattcctgcctttgcaggccagagcactcatgacttcagtgacctgcttctccccctctaggtctaccagccacagtctctgcacgtttccaagagcag

SEQ ID NO: 438162 - DNA, 4497 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438163 - DNA, 4641 bp, Homo sapiens
atggcagttgaaaaacaactgccaactacattacataaaagttgaaatggacgtggagtgtggtggctcacacctgtaatcccagcactttgggaagctgaggcaggcagatcacgaggactgaaaagtaccaggagaacagtggccacgaggggccccaacagaggaagaaaccagtgagtgagccctcgtgggatctggttgttgaaaagcgtgcatcacctcccgcttcattctctctgtctctcccgctccaccatagccagacgtgcctgcttccacttcgccttctgccatgactgtccgtttcctgaggcctccccagccatgcttcctgtacggcctgcagaactgcccggcccgggcccctcaggagcagaacagccttggtgaggtggacaagaggggacctcgcgagcagacgcgcgccagcgacagcagccccgccccggcctctggggagccccaggaggatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438164 - DNA, 4530 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtggaccagcatgccacggacgagaagtataacttcgagatgctgcagcagcacaccgtgctccaggggcagaggctcatagcacctcagactctcaacttaactgctgttaatgaagctgttctgatagaaaatctggaaatatttagaaagaatggcttcgattttgttatcgatgaaaatgtcatggatttttctcaaaattgtattcttttagctccagtcactgaaagggctaaactgatttccttgccaactagtaaaagctggaccttcggaccccaggacgtcgatgaactgatcttcatgctgagcgacagccctggggtcatgtgccggccttcccgagtcaagcagatgtttgcctccagagcctgccggaagtcggtgatgattgggactgctcttaacacaagcgagatgaagaaactgatcacccacatgggggagatggaccacccctggaactgtccccatggaaggccaaccatgagacacatcgccaacctgggtgtcatttctcagaactgaccgtagtcactgtatggaataattggttttatcgcagatttttatgttttgaaagacagagtcttcactaaccttttttgttttaaaatgaaacctgctacttaaaaaaaatacacatcacacccatttaaaagtgatcttgagaaccttttcaaaccagatggagcattgcttgcaaattttttttctctatgtttgcatgcgctcgtgtgtgtgtgtccaggcaagaacacattttataaaaataagaacacttgggctgggcatggtggctcatgcctgtgatcgcagcactttgggaggccgaggccggcagatcacctgagatcagaagttcgagaccagcctgaccaacatggagaaaccctgcctctactaaaaatacaaaattagccaggtgtgctggcgcatgcctgtaatccccgctacccaggaggctgaggcaggagaatcgcttgaacccgggagacggaggttgcagtgaaccgagattgcgccactgcgctccagcctgggtgagatagagcaagactgtgtctcaaaaaacaaaacaaaacaaaacaaaacaaaaaaaaccaaaccactttggaagttactcaggcctctgctctggctggacatagtttagtctataactttcaacccttaacaataattaaattcatctttgtttaatttcataaatttaaaagtagggtccttttcagttagtgattctcagccctgattcacattaaatttttaaacacgggggattctctgcccggctggaagaaaatgactggatgggacaggggtcactatttgaaacattcctctgtgcggccaaggtcgcaaaatgctgtcctcgcaggggaacaaaaagagtttgatttcccataatttgatgctgtgatttggtttcctcaggatgtgaactgtagaacattccagttactggccttgaatggttctgggaatataagaatccctgtctgtcttttcaaatagttttcatggaaccttgtcctgtttgaacttggctgccctgctgcccccaccccttctccagactgtgggcggctccccttcctgctttagaatccttcagatggaggaggcagtacagtagtcactgtgccatcgtgtctggcactgtgctggcgtggtctgcaggatcccacttatgaactctccagattgggagctgtggcaggataacagcccccaagacagctgtgtcctaatccccagaacctgtgaccacgctgcctcacgtggcagaagggactcggcaggtgtgattgagtgaaggatcttttttttttttttctttgagatgaagtttcgctcttgttgcccaggctggagttcaatagcatgatctcagctcactgcagcctctgcctcccaggttcaagtgattctcccacctcagcctcccgagtagctgggattacaggtgtccagaaccatactggctaatttttgtatttttagtagagacagggtttcaccatgttgaccaggctggtctcgaactcctgacctcaggtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438165 - DNA, 2466 bp, Homo sapiens
ggaggcgaaggggcggcgggaaccgggcctggcccgtgtgtgtcctgggggcctggcccaggccgccgctgtacggtgagtcccagggaggcggatctgggccccgggaaggacaccctcctggatttgccccgtaggcccggcccgggcccctcaggagcagaacagccttggtgaggtggacaagaggggacctcgcgagcagacgcgcgccagcgacagcagccccgccccggcctctggggagccccaggaggatttcgaccgcctctaaacgtccgtcagcatctctgttctctcatttaagtgtctgctgattccccccttagatctgccctggagactggtagtaatgcaggaacagtctgcagggattctctcttgctgcctcagttgctaggggaagagactgggccttagcaggtctaccagccacagtctctgcacgtttccaagagcagcagaaaatgaacacattgcagtcgaatccagcgggcattttctagcccctacctcccaggaccctttgtctgcctttgacatctgttacttccaaactgatactttctccatggagtctctcttttcttggcttttaaaaagattcgtctgtctgcagactcgtgaatgacgtctaccgcgtgtataatcgacaccagtatccatttgttgttcttaacatttctgttgattcaggtaacttaataaaaatgcatgcagcggatttggaaaagcccatggtagaaaagcaggatcaatccccttcattaaggactggagaagaaaaaagggacgtgtccatttccagactgcgagaggccttttctcttcgtcacacaacagagaacaagcctcacagcccaaagactccagaaccaagaaggagccctctaggacagaaaaggggtatgtcgtcttctagcacttcagatgccatctctgacaaaggcgtcctgagacctcagaaagaggcagtgagttccagtcagggacccagtgaccctacggacagagcggaggtggagaaggactcggggcatggcagcacttccgtggattctgaggggttcagcatcccagacacgggcagtcactgcagcagcgagtgtgtggccagcaccccaggggacaggggctcgcaggaacatgtggactctcaggagaaagcgcctgaaactgacgactctttttcagatgtggactgccattcaaaccaggaagataccggatgtaaatttcaggttttgcctcagccaactaatctcacatccccaaacacaaaagtgttttaagaaagaagaaattctttccaattctgacattcgtcaaaagttagtaaatactcagaacgtgtcagcttctcaggttgatgtagctgtgaaaattaataagaaagttgtgcccctgaacttttctgagttctttagctaaacgaataaagcagttacatcatgaagcacagcaaagtgaaggggaacagaattacaggaagtttagggcaaggatttgtcctggagaaaatcaagcagccgaagatgaactaagaaaagagataagctcagaccaccaggtgagaaccagaaaacgtccatggctgctttaacagagccatttcttgtcgtcaccgcgctgatactgcggaaaatccattttcaccggatttaattgtgtggaactgagaatgacagtgtcaatttctcgtgtgaagtaaaacgatgtttgcagaaatggaaatcattggtcagtttaacctgggatttataataaccaaactgaatgaggatatcttcatagtgatccgaccgcctcggcctcccaaagtgctgggattacaggtgtgagccatcatgcctggctgagttaaggatcttgcaacagagagattatcctggattgtctgggtgggcccagtccattgggtgagtccttcaaaggtggagacctttccctgctggccagagagaggctgccttgctggttttggagatggaaggaggtaccactagtcaaggattgcaagcagtctctagaacagggattccaacactccggacacagaccagtagtggtccatggcctattaggaagtggggtgcacagcaggttaggggccggcaagccagcgaagcttcatctgtatttatagccactccccgtcgctggcgttaccacccgagctccgcctcctgtcacatcagcggtgggcattagattctcatagcagcacgagccctattgtgaactgcacacacgagggatgtaggttgcacgctccttatgagaatctgatgcctgatgatctgtcactgtctcccgtcacccccagatggggctgtctagttgcaggaaaacaagctcagggctcccactgagtctctgtgatggtgagttgtagaattatttaattatatgttacaatgtaataataatagaaataaagtgcacaataaatgcaatgcacttgaa

SEQ ID NO: 438166 - DNA, 1218 bp, Homo sapiens
cttcagcctagttttaggtaacactgaagtctaaaggtatagatttgaaacaaatggaaaatgagatccccgaacattttatctttttaaaattattattttcactttcacccattaaattacttgattttttttaatgtttcgtaacttaggaagaataaggtccaaatcaactggaatactttttttagtctcataattacctgagtacctgcaatatgcacatcactttaccactgtacacttagtagcaacacgtcttgtacttaaaaatgtctaaaggtaagacctgtgtttctagtttgaaggcctagaaagtaaatgagtgaggtttttgtgttggtgtttcagactataaacttaaatggcctcagagaatcgggttagtgcttgttcatgactcaggttctgtgaaaaggctattcaaataaaaataaagctgtaagctctatcctaccaggtatagagacaaacaccaaagttacagtagatgagtattgtcaaggggttaagactgtggacacaagcaatagttaatggctttgggaattctaggaaataggagaccaatgtgggataggtgacattaggaagatttctttggcatctgggttttaaggttgggattgaaggtagagaaaagctctcagaatagacgtgggaagcatggaggtgaaggtagaaactaagaataagtaagattggaataagcagaagaccatttctggttctgaatctgtgtgtgataatgtctgaatgagttagtccagatggaagagcacagatggagggtgtgacgttctagctttagagaattaagctatatattccttgagaccaaaggaagtgtgaaagatgtaaacacctgtctcttaggtttaaggagttatagtaccagtccatagaaaagaaagtcctagctgttttagaactgcatggttgctccacaaggtaaaatgcctttgagacgcttatttttttttagctattttcaaggaagtatttaatcctcctgactttgagaatagtgaatatgtcttgtgttcataaatttaagcaaggatgaagaatgcccaataatgtgtgtgtgttttaagtgtgcttctcaattcatctaattcttcccagtttctaactattaagggagttagaggcttacatgcaggtgattttgttagaggcttactttgcagatgatttctttatgaaatcatgtta

SEQ ID NO: 438167 - DNA, 2443 bp, Homo sapiens
tggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgt

SEQ ID NO: 438168 - DNA, 1873 bp, Homo sapiens
tggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacacatgggggcaaccacatccagtacaagcttttacaaatgttattagtgtctttttttatttctaatgccttgtcctcttaaaagttattttatttgttattattatttgttcttgactgttaattgtgaatggtaatgcaataaagtgcctttgttaaatggtgaaaaaa

SEQ ID NO: 438169 - DNA, 4190 bp, Homo sapiens
ctggcccaagctctttttatatagcaaaatatttactgtttaacatttttaaatcttagctattataaaatcctgtagtatacaaatatagttagttttatattacattaaaaatattatagtctaaatttaaaatgatgaactgttaaggaaaaatcatttattataattttataagattttgcatgatttaatttacttttcccttctaatctccaactttggctcaaattatcacactacaagccagttatgagctcagacacatgacaaacaaagccttccgcacgggatttgctatgagaactaaataaattaaaaaaaaaagaaagaaaaaaacttagttgtttattttctcccctaaaccattactcccaacttctaacaaacagtagttgactacctaataaatatttgtagacctggattatggaggaggggtcagcaaggcaaataatttaaaactttaaaagccgaataaatttaactctgcccctaaatcatttaacaaaatagattcccatgttccaatggaaatcaagatttgtttttccataatgatgatcatcactttaccatcaactttcttgtctctgcacgtttagagaataaaatggcatttaatttgtactgagtataacctgaaggtggggtgggaaagtggattgcatcagcaaatgaagaaacaccagacatcagagacctgaacacctctgcactgggtgaaaactttgcaattaggtgtttctttaaatggctccacctgccttgccccggccggcatctcccatacctgcccccaccctggctctgaccactctgctctctctggcaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtatgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacttgatattaagggaaactaaagaaaatgttattgtggatcccacagtactatattacactgtttttttttgtttgttttgttagtttttttttatttaaagcaaacctcaaacattattgggtatcaattaccacctggttgtattaaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataacattcattt

SEQ ID NO: 438170 - DNA, 3923 bp, Homo sapiens
tggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtatgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacttgatattaagggaaactaaagaaaatgttattgtggatcccacagtactatattacactgtttttttttgtttgttttgttagtttttttttatttaaagcaaacctcaaacattattgggtatcaattaccacctggttgtattaaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataacattcattt

SEQ ID NO: 438171 - DNA, 4046 bp, Homo sapiens
tggggagacgccggccccttggcccagctgaaaacggaattctttgccggctggctccccactctgccagagcgaggcggggcagtgaggactccgcgacgcgtccgcaccctgcggccagagcggctttgagctcggctgcgtccgcgctaggcgctttttcccagaagcaatccaggcgcgcccgctggttcttgagcgccaggaaaagcccggagctaacgaccggccgctcggccactgcacggggccccaagccgcagaaggacgacgggagggtaatgaagctgagcccaggtctcctaggaaggagagagtgcgccggagcagcgtgggaaagaagggaagagtgtcgttaagtttacggccaacggtggattatccgggccgctgcgcgtctgggggctgcggaatgcgcgaggagaacaagggcatgcccagtgggggcggcagcgatgagggtctggccagcgccgcggcgcggggactagtggagaaggtgcgacagctcctggaagccggcgcggatcccaacggagtcaaccgtttcgggaggcgcgcgatccaggtagctggggccccagggcctcgccggcagggggcgcgcgaacgcggggcgcggcctcggcggatcggggctggaacctagatcgccgatgtagatttgtacaggagtctccgttggccggaggtcatgatgatgggcagcgcccgcgtggcggagctgctgctgctccacggcgcggagcccaactgcgcagaccctgccactctcacccgaccggtgcatgatgctgcccgggagggcttcctggacacgctggtggtgctgcaccgggccggggcgcggctggacgtgcgcgatgcctggggtcgtctgcccgtggacttggccgaggagcggggccaccgcgacgttgcagggtacctgcgcacagccacgggggactgacgccaggttccccagccgcccacaacgactttattttcttacccaatttcccacccccacccacctaattcgatgaaggctgccaacggggagcggcggaaagcctgtaagcctgcaagcctgtctgagactcacaggaaggaggagccgaccgggaataaccttccatacatttttttctttgtcttatctggccctcgacactcaccatgaagcgaaacacagagaagcggatttccagggatatttaggagtgtgtgacattccaggggtcgtttgcttttcagggttttctgagggaaagtgcatatgaaatccttgactggacctggtggctacgaatcttccgatggatgaatctcccactccagcgctgagtgggagaaggcagtgattagcacttgggtgacggcagtcgatgcgttcactccaatgtctgctgaggagttatggtgaacccacaacttaggccctagcggcagaaaggaaaacctgaagactgaggacaaagtggaggagggccgaggtgggcttcagtaagtccccggcggcgctttagtttgagcgcatggcaagtcacatgcgtaaacgacactctctggaagccctggagaccctcgcccaactccaccagatagcagaggggtaagagaggatgtgcaagcgacgacagatgctaaaatccctggatcacgacgctgcagagcacctttgcacaggatgctggcctttgctcttactacactgaggagagattcccgcgggttccgcaggcagactacacaggatgaggtggtggagtggagtgagagcaattgtaacggttaactgtaacgttttctttcacacacacacacacacacacacacacacacatgctaggatgcggaaatccccttatgacttgctactttttgattttgtgatattttgtactttttagttgttcagcaactgtcttatttaatggggagattttaagtaacataactagtggctctcagttaaaatgtgaggaagaactacagctcttaaatgtagcaatggcactgttgcaaactcagtgcaaacgcctagattgctttcttcttaacctatttatttctttgttaaatttttctgattgtttcctttatagagtgtctcagggtgcagaggtcagactaagaaatattccaaatgtcttttagaagatagatgcacttatgcagtaaattatcttgggatagttcccaaaagattgctgaaaaagtagattgagtataaaaacttgaaaatatatgatggctcgtgggatgtcctactatcactgaacaaactaaaggtgcactgctttgggatttaatttccagggttgcttgatcattatatcattggaacaactgatacttcactactttaataaagaattaacagagattgaactccaagaggtgggtaatttggtttaaaaatacatgttcatgggtttaccactaactcctgagaaatgttaaaggttcacaggggttcccttctctcaatgtttgtaataattgctcataagcaataccagcaattcataaaaactgcttacttatgccatagaaaattaaacacaaagtgtatacatgtattatgcttctaaatgctcattctaccagatacacatttaaaagagaaaaaaggaacagaaacaagtcatttgagagtggagacttataagaaggagtacatttgagttgaatacacaaatctttacttctctaccaattcctattcccaaaatgaacatattactggggaaagttagttgagaatcagagcatatgttattggggaaaggatatgtttattgacacataatctgtaccaggtatgcattaaaatatatttgttaatttaatatttaaacctgagagataggtatgtttcccagatgaggacaatgaggcaaagaaatatcaagtaacttgccaaaggttacaagatattcattccatggatgcacaaagaagtgcatctagttccacagctgattatggttgtcttgcttttcttcccattgcaccagcttgtcctccaaaatcatgaatgatacacatgaagataactttttttaaaaaaaagcagaaatacacaatgatctcccttgtaagctcctaaggtggcttttctttctctaacttctagtaaatataaacggtttgtttgaaaactattttaaaatgtcaacaatatggagaataaccccccccaacacacctataaaaacccaaatttttggaacaaagataatggaacctccattttcaaactgaagcacagggacagaaaatatatttctagttatcacttaagcactcaatcattagaggctacaagaataatatttttaaagttacagtattttacaattattagaaaacattctatataaaagaagtcagttgatactttaaaatctcccatttggtttataaaatcccttaatttgacctctatatcttaaattccaagatgtttaaatttgctagttgcattatactgggtcatgaaaaattatcccttgaaatagatatgaaacatgttacttcatttctggtttaaataacttgtggaatctttcctaatgacaacttgatattaagggaaactaaagaaaatgttattgtggatcccacagtactatattacactgtttttttttgtttgttttgttagtttttttttatttaaagcaaacctcaaacattattgggtatcaattaccacctggttgtattaaaatagtaacttatcaatgccatgtaaaaattaattccattttcgaagccacctggcagacaggtttagctgtttcatcagcagcctaatatatactgttaaatttgttaaggatttcactttgaaggatacatgcaaaacatatagttactattttcatgagtcctgcttctagctccattgtggaatacagaaaattaaatatacctgttaagttcgtatctaaacctaagacattaccaaggtttgtacaaattctactacctgacatttattccaagaagatctggaaagttaaataaatttataaatttaataacattcattt

SEQ ID NO: 438172 - DNA, 4874 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438173 - DNA, 4960 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatgagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438174 - DNA, 3932 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtcccggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438175 - DNA, 3161 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttgccttcggggtcttgtgcctggggctgggttgcaggacccctgatcctcatacccaccttcccctgtgatcttgggtgcctttgctcttgctgcaaatggaggccaacctcacaggggtgctgtgaggaccagggaggacaatgtctgatggcccctgtgggcactgggctggagaacacgagcccagcctgcctgcaggagtgatgcggccggcttccgtacctcctgccatggaactccactctgtcctccttactaccccgtgaagtggggactcataggcttggggctggagactcccaggtgccccaggtgtgcccagccctgagagtctctgagcctctagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtccaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcaggaagacctggcgggcc

SEQ ID NO: 438176 - DNA, 2219 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtcccggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttgccttcggggtcttgtgcctggggctgggttgcaggacccctgatcctcatacccaccttcccctgtgatcttgggtgcctttgctcttgctgcaaatggaggccaacctcacaggggtgctgtgaggaccagggaggacaatgtctgatggcccctgtgggcactgggctggagaacacgagcccagcctgcctgcaggagtgatgcggccggcttccgtacctcctgccatggaactccactctgtcctccttactaccccgtgaagtggggactcataggcttggggctggagactcccaggtgccccaggtgtgcccagccctgagagtctctgagcctctagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtccaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcaggaagacctggcgggcc

SEQ ID NO: 438177 - DNA, 861 bp, Homo sapiens
  misc_feature (791)..(791): n is a, c, g, or t
  misc_feature (855)..(855): n is a, c, g, or t
  misc_feature (858)..(858): n is a, c, g, or t
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgncttccattgatgaccccttttcaatggaccttcaacacaagtttgacttcccttgaaacttggnccnaaa

SEQ ID NO: 438178 - DNA, 4631 bp, Homo sapiens
tgtaaaagtagcagcagctcagccctgaccatctcctctctcacttgtgggagtctcatttagggatcgtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438179 - DNA, 2850 bp, Homo sapiens
  misc_feature (19)..(19): n is a, c, g, or t
  misc_feature (28)..(28): n is a, c, g, or t
  misc_feature (49)..(49): n is a, c, g, or t
ggccaacccttaagccaantcattgccnggatttgaggagtccaagaanaggtgaaaggaagactagacttgatgctcctggctggttctcttcagagacaggacaggaacgagagccaggctctggtccggccgtgtgcgagttcttcagcgttgccctccacatctggagtaacatattggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438180 - DNA, 4208 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtcccatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438181 - DNA, 3956 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438182 - DNA, 2243 bp, Homo sapiens
atttcctcccagcctcgtgcgggaaatggctttaattctgacggcagggctgtgagggactagcgggaacccgagccttttgtcaaggaactgcggtgtcggtggccagtcatccccgccgccgcggagccgctgcactgctgggggatctcccagcagctctgacgagcgcgggctgcagcatgggcagaaaacgctgacctgcagattagctgggtggattttttaagcgcaccccaccccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgccccaggaagtactggagatgaggaacaagattcgagaacaaaaccgacaagatgtgaagtcagcggggcctcagtcccagctcctggcgagcgtcattgccgagaagagccgaagcccggtagagcagaggctgcccctgactggcggggaaacgtgtttgccttgccttcggggtcttgtgcctggggctgggttgcaggacccctgatcctcatacccaccttcccctgtgatcttgggtgcctttgctcttgctgcaaatggaggccaacctcacaggggtgctgtgaggaccagggaggacaatgtctgatggcccctgtgggcactgggctggagaacacgagcccagcctgcctgcaggagtgatgcggccggcttccgtacctcctgccatggaactccactctgtcctccttactaccccgtgaagtggggactcataggcttggggctggagactcccaggtgccccaggtgtgcccagccctgagagtctctgagcctctagcctggtatgacatcatccaaccagagctctggaaagatgatcatgtacccatagagaaggggtatatagacaggacccatgctcctacaggatgggaagggacaatattacccacacaaacccacattgagttagaaagtattgtaattgtttttgtgcttgagatagaacagtgttttgtctagtgcttagcaaaaggggtgaagttcagaattctggcatgtgtttgaaatcactgctgctccttgcaaggtagcaatgggcatgacattttccttagcagtaaaaattggggaaatacaggaaatgttcctctctgcagggcaaattgtgatgatgcaatgatttcaggtcaagactgcagcccacagggtgggtgcccattggcaggagaagtgtgaaagttgtatcatcacacttacctccccccaaccccaactcagccaagatggggaacactgaatatcccgcagggtccaagtatagaaatagccatgttctggcgggaggtgagagttcattacaatgagcaacactgttaaaaaaacaaacaaaaatctcccctgccatttataccaagtgctcttctcggagtccctcttcttgggtttttggtcttggattctcggttgactccatgattccctacattaggcctactgtggcctcccttttggaaggggcccaggggcaggaagacctggcgggcc

SEQ ID NO: 438183 - DNA, 4731 bp, Homo sapiens
gaatgtctgcacagccgctttccacacagacatcataacaaaaaatttccaccaaaccccctccccccgcttctggccacagcacttaaacacatctcccccaaacccataaaataacaaaaccaacccgcagtggccgaccggagatagctaagatgccgcgcaggagtttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438184 - DNA, 4704 bp, Homo sapiens
agcggtgcgaggcgggcttggcggggctgggcgcgtcccccggggcctcgcgatcgctggctgcgcggcgctcagccgcagtggccggccgagcaggtgcggcgtcggcagccgcctacattgagatcggggcaaccggcactttccacctggatgtttgaggttgtgtagatgtggccggcacccttgagagtggagctagggggtgcagactgagcagtgaacagaaggagccttggacagggctgggccagcctcccgagttccaggagcgaattgcaaacccaccgggaaaatgagcgaagagacggtccccgaggctgcctcgccgccgcccccgcaggggcagccttactttgaccgcttctcagaggacgaccccgagtacatgcgccttcgcaaccgggcggcggacctgcggcaggacttcaacctgatggagcagaagaagcgcgtcaccatgatcctgcagagtccctctttcagggaggagctggaaggcctcatccaggagcagatgaagaaggggaacaactcctccaacatctgggccctgcgacagatcgcggacttcatggccagcacctcccacgcagtcttcccgacatcttccatgaatgtctccatgatgacgcctatcaatgacctccacacagctgactccctgaacctggccaaaggggagcggctcatgcggtgcaagatcagcagtgtctaccgactcctggacctctatggctgggcccagctgagtgacacctatgtcacgttgagagtcagcaaggagcaggaccacttcctgatcagccctaagggagtttcttgcagtgaagtcacagcgtccagcctgatcaaggtgaacattctgggagaggtggtggagaagggcagcagctgcttcccagtggacaccacaggcttctgtctgcactcggccatctatgcagcgaggcccgacgtgcgctgcatcatccacctgcacacaccggccacagcagcggtgtcggccatgaagtggggcctcctgcctgtctcccacaatgccctgctggtgggggacatggcctattatgacttcaatggggaaatggagcaggaagccgatcggatcaacctgcagaagtgccttggacccacctgcaagatcctggtgctaagaaaccatggagtggttgctctgggtgacacggtagaggaggcattttacaagatcttccacctgcaggctgcatgtgagatacaggtgtcggctctgtccagtgccgggggagtggagaacctcatcctcctggagcaggagaagcaccggccccatgaggtgggctccgtgcagtgggccgggagcacctttgggcctatgcagaagagtcggctgggggagcatgagtttgaggccctcatgaggatgctggacaacctgggctacagaacaggttacacgtatcgccacccctttgttcaagagaaaaccaaacacaaaagtgaggtggagattccagccacggtcacagccttcgtgtttgaggaggacggtgccccggtgcccgccctgcgacagcatgcccagaagcagcagaaggagaagacccgctggctcaatacgcccaacacctacctgcgggtcaatgtggccgatgaggtccagaggagcatgggcagcccccgacccaagaccacgtggatgaaggctgacgaggtggagaaatccagcagtggcatgccgattcgcatcgaaaacccaaaccaatttgtgcctctctatactgacccccaggaagtactggagatgaggaacaagattcgagaacaaaaccgacaagatgtgaagtcagcggggcctcagtcccagctcctggcgagcgtcattgccgagaagagccgaagcccgtctacagagagccagctgatgtccaagggagacgaggataccaaagacgattcagaggagacggtgcccaaccccttcagccaactcactgaccaggagttggaggagtacaagaaagaggtggagaggaagaaactagaacttgatggagagaaagaaactgccccagaagagcctggctcacctgcaaagtctgcacctgcttctccagtgcagagcccagcgaaggaggcagagacaaagagccctttagtctctccttccaagtctttagaggaaggtactaagaagacagaaacaagcaaagccgccaccacagagcccgaaacaacccagccggaaggggtggtggtcaacgggagggaggaggagcagacggcagaggaaatcctcagcaaaggcctgagccagatgaccaccagtgctgacacggatgttgatacctctaaggacaaaaccgagtcggtcaccagcggccccatgtccccagagggctcaccttccaagtctccctcaaagaagaaaaagaaattccgaaccccctccttcctgaaaaagagcaaaaagaaggagaaagtggagtcctgattcatgacacccttgggctccctcctgcctcctctctctcctccccttcccttctcccatctctgtccctgcaagcacagggctaaggagggatagagtaggaccctggaccacattcggaaggggaacttagagatcacccgaccaacccttcgttttacagttgcccaagagaaatcaggtgacttgcccaaggtcacacagctagttagcggcagagcctgcactcgaattcaggtctcctgacttccagtccagtgctccttctactacacaacactgcctagttgtgggctgcctttgtttggatgctgtccaccaatctgagcctagggcaagaaggccagaaatgggccgtgagctctcacaggctcagactaaatcagaggtcaaggcttcccctgagtaaggtccatttcttcccaggaatccaatctcctgtggatggagctatctctacatttaaaaatctcttctcttttccactttgggtccctgccctgctcgctcaaagtgactagccaaattgacccctccaacagaaagtaatctttgttcccaagggctgatggcttagcttgtactaccccaaacattaaccctgagctttcttcatggaacctcttgaatgatggatggaagagctataagaggtggtaggcataggggcaagccatgtaagctgaggattggggatggtttcatcaacataagaggccaggaacttgacccctttgaattgtgcatctcaggcacttcaaaactaaaaccaaatttagcataggaaaaagttgtttaatgctcagggcagaaatttggggaagttgaaatcctctgttggctttgggttgtataaggaggatcaaaacaacagaggaaatgctgactttctagctttgcatgacacctggagcaatgcactgtacctgcctcactcctgtcccagtggtcaggtttcccctgaccttccctcacccccagaaacacttgcttacagaccgaaactggcatcttactcttggcaccttgacttgcaccctctgaggttccaactcagtcattctttgtccagcagaggagaatcagaaatgagcccttcaggattaatcctcttgcaccagctctcagagaaatgctgggtatccctgtccttgtccctatctgtccatcctggggcctggtaatggccacagttattgttttaaatgccaacactgtcttctcatgttcttccgtggggcattgattaatgagcatttgttggctcctaaaaattagacaatccattctcttgaaagcaccgtgtcttgaaagaatatttttccttttgatctgactatcgtgaaaatatttttgaaagttcttaatcatagttttccacttttgagcacttgctatctatagacactgtgcaggcttcacatacattacattctttaaccctcacagtaatcctttgaggggggtaagatcattcccattttgtgggtgaggaaattgaccccctaaaatgataattgacttgtcccagctgacttggctagaaagatctggatcctgggatttgaatccagggtcagtctgagtccagagcccttgctcttaacagctatggtgaacagacaactttaatccccaggggtggtggttttcatccaggatttgtctctatgactgttctccattggcataatgttagcacgtgaagcaaaggtagggaacaccctgtgctcatcctcatcactgcacgtgaagttcctggtcaatgtggactgtggtgatgctactgtgtgcctctgacaaaggagaggcaagagccttctggttggggcgggaaataccatccatagttggctatttcttgagaaggaaggaaactgacctaggaccaaggtaaacctgacactgtgtctctctagtgcagattcctaactgctaccccaggctccatctctgttctacttcctgattgggtcaaattttaggagggacaacccactcatgcctcagaaaaatctgtcatatgggaaatgcctttaaaagccaatcccttgatgccttcttttaaaaagtagatttcacacttattcatttatccttacatggtatttgttaaggatccactgagcaccaggcattatgctgacgttgaaagagagccatcattatgactagaataataagtggcaaacgatgttgtgagaatggtgaacacgacctctgatgca

SEQ ID NO: 438185 - DNA, 836 bp, Homo sapiens
aagaaggggaacaactcctccaacatctgggccctgcgacagatcgcggacttcatggccagcacctcccacgcagtcttcccgacatcttccatgagtatgtggtgtctggggagctgccaggagcagaggtggaggggagggtggggtggggaagagagggaggagcagcaagaagcatctggttgccaggctatggagtaagcagcccattgtgttatcaggccttggggagctcagcagcagccagagaggtacctggctctgcttctgatgttgctgcaaattaaacgtccacagaaaaattaccccaatgccaggaataagagggtggaggtgacttcagtggacgggaagagaccactgaagcctgtgtttccatgccccactagacaggccaacctgactccacagatgagggctgagaggagccagccagggctatgcaggaagccaccctcctgggctgttatgctctgcccataacgtttaaaacacaagcatcaaaaaataactccccctcaataagattattacaggattatggctgaaaactgtgaaaataaccaagaaagggaagcagaaatcattctactgtgttcttaaagccctcatattactattcttaatattttggtgaacatatatccttccagtcctttttttcttaacatatatagattatgcaaacacaaatgtaatcacataaaatatggttctataatataatttttggtggatacatgctatttaataaatttcccattgttggacttttaggttatttccaactttttctgttaggaacaatgcaataaacatccttgtaaataaac

SEQ ID NO: 438186 - DNA, 4629 bp, Homo sapiens
gagatggagtctcgctctgttgcccaggctggagtgcagtggcgcgttctcagctcactgcaagctccgtctcccgggttcacgccattctcctgcctcagcctcccgatagctgggattacaggcccccaccaccacgcccagctaatttttttattttttgtagagatggggtttcaccatgttggccaggctggtcttgaactcctgacctcaggtgatccgcccacctcagcctcccaaagtgctgggattacaggcgtgagccactgcaccagaccctatctgtccaaatcttttgtcccactttaaattgttttttcttcttaacattgaattttaagaattcattgtatcttttaatattctgaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctgtctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcatagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttctttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctgggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatgga

SEQ ID NO: 438187 - DNA, 3262 bp, Homo sapiens
  misc_feature (443)..(443): n is a, c, g, or t
tccgtctcaaaaaaaaaaaaaaaaaaaaaaaaacagaaaaaaggccgggcacggtggctcactcctgtaattccagaactttgggaggccaaggcgggcggatcaggagttcgagactgcctgggcaacatagcgaaaccccgtctctactaaaaatacaaaaaattagccaggcgtggtggcgggctcctgtaatcccagctactcaggaggcttaggcaggagaatcacttgaacccaggagtttgaggtatcttttgttgatctctacactgattgtattctctcttttattctatgacagttaaagattttttctgatactacattattgtcagttttttaaatactcagtttgtgctaaaagaaaacattcggcaactgatatctgctgttctgtatgtatctgtcagtccagatttgtccattatggtgtatgaatntaatagaacctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatgga

SEQ ID NO: 438188 - DNA, 3103 bp, Homo sapiens
cccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtgatctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatgga

SEQ ID NO: 438189 - DNA, 5149 bp, Homo sapiens
  misc_feature (4640)..(4640): n is a, c, g, or t
gagatggagtctcgctctgttgcccaggctggagtgcagtggcgcgttctcagctcactgcaagctccgtctcccgggttcacgccattctcctgcctcagcctcccgatagctgggattacaggcccccaccaccacgcccagctaatttttttattttttgtagagatggggtttcaccatgttggccaggctggtcttgaactcctgacctcaggtgatccgcccacctcagcctcccaaagtgctgggattacaggcgtgagccactgcaccagaccctatctgtccaaatcttttgtcccactttaaattgttttttcttcttaacattgaattttaagaattcattgtatcttttaatattctgaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctgtctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcatagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttctttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctgggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatggaaaaaaaaaaancaaaaaaaaaaaaaaaaacaaaaaaaaaaaaaaaaaaaaaaaaaaaaaaaaaaaaaggggggggggccccaaaaaaaatttccccggggggggccccaatttcccccccccttttttttgtaaaaaagggggcccccaaaaggggggggcaataaaaaaagggcgcgggggccggaaaacaaccggcggtggggcggaggaaccacgcgtcgaggcggatgttggaaaggccccccctctctgtgggggggcgatctcggcgcgccaacccaccaccaaaattttacgggccgggggaaaaaaacatgccgtggtatgctgcgaccccagaatctcgctgcgggagaatcggtccggtattctacaaataagtaggcgacaatattaaccgagcactacacaaccacagtactagaaacacactgcgataacacccttactcataacataatctaacaaaaaacactcccaccaaccacaacatacactgacactactacaccgcatat

SEQ ID NO: 438190 - DNA, 4715 bp, Homo sapiens
gagatggagtctcgctctgttgcccaggctggagtgcagtggcgcgttctcagctcactgcaagctccgtctcccgggttcacgccattctcctgcctcagcctcccgatagctgggattacaggcccccaccaccacgcccagctaatttttttattttttgtagagatggggtttcaccatgttggccaggctggtcttgaactcctgacctcaggtgatccgcccacctcagcctcccaaagtgctgggattacaggcgtgagccactgcaccagaccctatctgtccaaatcttttgtcccactttaaattgttttttcttcttaacattgaattttaagaattcattgtatcttttaatattctgaatgctagttatttgtcagatacatgttttgcaaaccatttatctgtatttggtttctttttgttatcttagcagtgtatcctgaagaatagttttaaattttgatgtaatccaaaatatttcggttgtttgtgttctttgttatcctgtctatttttgttgttgttgttttatagatatgggggtctcactacgttgcccaggctggtcttgatctcctgaactcaagtgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcatagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttctttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctgggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatggaatataaaatttactttaaatttttaatattatataaaaaaatcttgagggggggccctgtaccaaattctccctataggaggttga

SEQ ID NO: 438191 - DNA, 1748 bp, Homo sapiens
cccttcacggtacctcaagaagaagtgagctctctttcttctaattctttgttgtttgaattgcacaaacgtttaaatatatctatatctataattccttattaggcttaaaattattaagtgaaaatacttcgttacaggccgtgtgtggtggctaacactcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatgga

SEQ ID NO: 438192 - DNA, 4250 bp, Homo sapiens
gtcgaccggagtctcactctgttgcccaggccggggtgcagtagctcaatcttggatcgctgcagcctccacctcctgggttcaggcaattctcctgcctcggcctcctcagcggctgggactacaggggcacaccaccatgcccggctaatttttgtgtttttggtggagatggggtttcaccatgttggccaggctgatctcaagctcctgacctcaatgatcctcccacctcagcctcccatccttgtctacctaattaggctttgtgtaactcagtgttgcaaagctttgacatctgtttgagttaatgtttatatatgttgttacttaagggtttcacattaaatttaaacatacttatattttataaccaaacaagtcatgttggggcatactcattaggattgagtgctttcttacaccaaaatacatgtatacaaagatttaaaacactttcggccgggcgcggtaatcccagcactttgggaggccgaggcgggtggatcacaaggctaggagatcaagaccatctggctaacacggtgaaaccctgtcgctactaaaaaaatacaaaaaattagccagacgtggtggcaggcgcctgtagtcccagctactcgggaggctgagacaggagaatggcatgaacccgggaggcagagcttgcagtgagccgagatcaccccactgcactccagcctgggcgacagagtgaaggctatgtctcaagaaaaaaaaaaaaaaacttttataataacaactgtaaatagttcaattgacagtcatttgtaagatgtttaagtaaactgtgaaacagtaagtaaatggatgaaaacacactgattaaaactgctgcttttatccaacaagatggatgaatttcccaggaaagaatacttgagttcaggcctgttcaagtcccaacctgtttgtggtttgaggttgctctctgcctcatagagcaaagtggaaaatttatcttctgggaggacagagttttcttctctgaaaaagtttcctacatagttggctttggcatttgcaaggaatgaaaggtcagggattgaggcctcatgagtctggatttctagctgaggttgagagaaaaggtagtgattgtaaccagaaaatccagagtgggtgtatttacctccagaactcatcacttaaaaaaaaattttttttgaactgacatgcttgaggctttttctttttttttttttgagatggggtcttgctctatcccccaggctggagtgcagttgtgcagtcatagctcactgtagccttatcctcctggcctaagcagtcctcctgcctcaacctccctagtagctgagaccacaggcgcatgccacctgtgagtttctagagatgaggtctccctatgttccccagcctgggtcttgaactcctgggctcaagtgatcctcctgcctcagccttccaaagtgttggattacaggcgtgagccactgtgcctggccagagctcatcactgttaactcagcctgggtttttcacagcagtcatggaaatagattcattaataatagtaacaaatatatagtctccctctcaaagaaaccttgagtggcagtggcataccagatacacagtaggaaatactgtagaattatgttgttaagttcataaccaaacatcatacatgatgataaaagacaagataatggtcacatttatgcagtattaactgagagggcaaatttgtgcctgagaagctattgggaatgttctctctctttgcattactaggaattacatgggaaacacatgtagacagtcttcaggctattaagatttgtccacttaatctttacttatacatgaataaaaaatgggaaaacatgataaatataataaactaatacactcaaccctgccccttgattatataatagaacaaaatcagcatgcccggcatgagcctgccagattgccaattccatcctccaccttcagaggatgccgccatccagaattttgccttactcattttactttcttcatagttcgacaccttaaatgtatattactaatagtagctttgcatttttggctgatttaaaaattgatataaatgaaataatgctgtagagatgctttttggtattaagtggatatactgttattcttaaagatgtttgaaatgaatatacctttctaaatatctttttaaaataatacattaaatgatactgctttagaattcatgaactgcatctcatgagaatatgtagagatgacgtgggcaggtaaagtaaaacttcaggttgaatatcctatgataatttaaaaatgacaaaatagtgtggtgaataatagagcttgagcactttaaggcaccatagggaccccttcaatgtaatgatgacagtgctgaggtgcagagaagttaggtaatcagcccaagccactactctaaggacagaccctatctacttttcctaatttgtcagaagactgcctatgatactactaataaaaagtcctatgaaattggtattgtcattattttacaaataaaataatcttcaatttttgtttcctctatgcatgggttacttagtattttgtaatttgaatttcaagcataattaaaaagaaatcaggtatctaggctgggcatgatggctcaagcctgtaatctcaacattttgggaggctgaggcaagaggatcacttgaggccaggagtttgaggtatcttttgttgatctctacactgattgtattctctcttttattctatgaaagttaaagattttttctgatactacatattgtcagttttttaaatactcagtttgtgctaaaagaaaacattcggcaactgatatctgctgttctgtatgtatctgtcagtccagatttgtccattatggtgtatgaatctaatagaacctcaccaatgttatacctgccttcttgaaatcattactgagatagctaatattaaaatatcctggtttgtctgtatatttaattctttactctcattatactaaatttttttaatgtaatttgaattgatggtaaaaattgtatacaggccgggtgcagtggctcactcctataatcccagcattttggaagtcctatgcaggaggattgccagaggccaggaatttgagatcagcctgggcaacatagtgaaactctcatctttataaaaagtaatattaaaatttttaaaagtgtataaactgtaaagtatattttactggtgttttcttccttattcctacttgtcagatgcaaatacacatttttgtgtgtttgtgtttagtaattataagtatacatattttcttctatttcatatatttctatgacattatatcttagatgtgtaatttatgaactactactggattattttaatccattagaaattactattcacgcattctgtattcaattcatgtgatagctaatatatttggttttaaatgcatcttattttgtggttttcttctaggctgttttttgtgctttcttttaaaaatatataggttttaataatcttaattttcttttagtttgaaatgtatatactcattttattcattagtctaagataagaattgtaacacttctctaacctattatagaattgttaatacctttacccttctcttgaacacatcaaaggatgtcattgagtgttggtattggagtatagcatatctattattctgctcaattagaagatattgttcatgttgtatagagataataagtaattgtattgatctgcagatgcatccatctcttggattctcattccttctaccactgcagaactttcacctgtaatcactttcctttggccttaaggataacttttagggttacttttctactaaatttccaatttttgaccagatataatcttatattgtgctcttcctgaaaaatactattgttgtggatagaaatctgggttggtagttatttcttcagcaatttgaccatgtcattccactgtgtccctggcctcctgtatactggatgtgaatggatacaattatatattgtgtttatagttttcctgtgctataggaacagtattcgaatctgatgcaaaggacaacacaccctagagattgtaacagtgagatgaaccaagtgattggatggggttttgagttgctggaataatggagttacagtgtacaatgcataagcaacataataaattatatatctggtgaacaaaatgga

SEQ ID NO: 438193 - DNA, 1940 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccata

SEQ ID NO: 438194 - DNA, 1882 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccatta

SEQ ID NO: 438195 - DNA, 2799 bp, Homo sapiens
  misc_feature (1093)..(1093): n is a, c, g, or t
ccttaaaggaagaatcagtgtcttcatctctgggtccctaatgttcctttagaactggtatacatttgaaaacaaatatttgagtacacactatacagcttacactgtttttggcgctggggatacagctgtgaagaaattcagacacttttgagttaatggcttaatctaacctttgagatccttgtttttgttttgttttttctctctttacattgggttttcttgagtctgggtgctgttttgcagcttccattctttatattttgtcttactgttagtgtgtatcagagtaggaccatgtacgttttgttttcctgcataaattagataaagtattgtgtagtgtcaggcaggcagtcctaagaaggaatgccattatctccaacatttgttttgcctctcactgtagctaccacaaataaaagagattgtattattcctaggactttccaccttagaataataagctataatagtaagaattttgaaatagttttatcagaaaattgctagttgaatagcatcattcttacggtgtctctggttgggaaattatataattggggaaaataaacattattgaactctattataaaagacccactgacagagacatgttttaactttgtgtaattatatgcactagtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcaggaacacagaagacactgctagaacttgaaggcaaaaatcattaaacaactganaacacaaaatgagcaggttggtggtggtgccagcctggtttttaatctcttcaaatccacacaaagaacagcaactaggccaggcgcggtggctcacgcctgtaatcccagcactttgggaggccgaggcgggcggatcacgaggtcagaagatcaagaccatcctggctgacacggtgaaactccgtctctactaaaaatacaaaaagttagccgggcatggtggtatgcgcctgtagtcccagctactcgggaggttgaggcagaagaatcgcttgaacccaggaggcggagtttgggaggttgctgtgagctgagatcatgccactgcactccagcctgggcgtctctgtctcaaacaaacaaacaaacaaacaaaaaacccagcaactgaatagcaaaaccaagggcccagacagtactttcaacaaagctaggtacaaggtaacttcatgagccccagaatacagtagttgaggcgaaatacctattgccacaagaacatttttgtaggaggaaaatgaaggaaggaaaagagatagtatatgagaggcctgagaacaggagaatccaaaataggcaacaggtgatcaatggagagttgggctgccaatcctaaaatgtcagctgaagctgggagaggctctccaacagtggatgagaacaaggacctaaggcaagaacgcctgaaagggctggagcactgtagcccttataaacagttgaggctgatcggctctcttttaggacaaggccccacaccagggaaaactcctggggctaaaactcctgggagcaggacagggacaagagaggaaagtaagagatggcccagactcaagaaaggataaagacagaggcaggaaatgccagaaagcaacttgcaatatgtttgaatccatacataagagaagagggactgctctgagaaggttgaaaagcttgcctgaacatacactcattccaaaaagtcaggaaaacaaattttacataaaaataatataaaagtatcaagatcaaattctatacacagttattaagaaaaaaatgcgaagaaggagcagattaacatccttacagacaatgaaaacacaccagggagacaccataaaacagaccaagactaacttaaaaacaaatacatcagcctgggcatggtggttcacacctgtaatcccagcactttgggaggccaaggcaggctgatcacttgagcccaagagttcaagaccagcctgggcaatatgatgcaaccccatctctacaaaaaaaaaaaaaaaattagctgggcatggtggcatgtgcctatagtcccagctactcaggaagctgaggtggaaagatcacttgagcctggaaggtccaggctgcagtgagccatgtttgagcactgactccgggctggacaacagagtgagaccccatctcaaaaataataataataacagataaacagataatgatttaagagataaaagacagtgaaaaagaaagatatgtttaaataaaaaggaaatgaagagataaacaagatttgagggaaattgacaaatattgaaagcagcaaagatcaaacatacaggtaataggagttcctaaagaagaaaatcaagtaagggaggaacagaacaaatgccaaaagatataattcaagaaaacatttcagaaatttaaaaatgttgaaactacaattgaaagtataccaa

SEQ ID NO: 438196 - DNA, 431 bp, Homo sapiens
tagtagaggttaatttggtaatggagttatggcttagctattctagcatatgttaagctcatttttgtattttaatttaaagaataaaatcattataggagcagcattaaaaggatctttccgtaacatggtttacatttgcaggtagttttgcagaagtgcaaagtcaagtctctcttgcacagtcctggagactacatcctcttaagtgcagacaaatatgagattaaggtgagtttttttctccattaatttgcttcattaaagaaaaactggaaaacataagaaaatgaaagtggtatggcaaagggtgaacattctaggaagaggagggggagtgtcttagtccaagccattttaaacccaccggaagaagagatgatttgctagctctatgtcctgtgtagtttcttaacttggatttgtaaatg

SEQ ID NO: 438197 - DNA, 7011 bp, Homo sapiens
agcaccggaagccgctcccctgtgaggctgcggaccgggagcagcggccgcaggtccgggtctgtatgcgaggcggggccggtcggggaggggactcttaggcgcccgcggctctgctgacccgccgcgccttggctgtttttctttccctgcaggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438198 - DNA, 9147 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccccccaaccacttcagacattttatccaaccaatgcagggacttttcaaaagtcagtgtgtttttgaaaatagaacaaccccttgagtgatctgaggtggctctgtttttttactgtttctgcatcttctagaaggtaaactcaacaatataaccatttctgaaggtgatccaaaaagcaaaacaataaaggtaaaacacaaggaaataattttggtgaatttcatgaatagttgcaaatgaagggatggggtgggtaaaagtcccattttgcttccagaccttggaatagtcttcctctcttttgcccaaggatgtgtctatccagcacatctttgcatgagttctttcttactaacttaaacttacggggcttcttgtcatttgagtaccacggccctgcacctttgatcccctgacagcatcattaagggcagattgtcattcctgttttacagatgagaaagctgtggcttggtaaagtgattcattgcctagaggagttatagtaagtggtgaggctgaagccctgattttcagcccccacacacctggattttttccatgttttcatgtttgtctgttctttctgtatttcaagtctcttcaaatcccgactgctgccttctgccttcaccacttgtgtgcactgttcaacctgtcttatgctttgcttccagggagtctccccaaccacttctttgagcacttacttgctcttgttcaatcttggtaactctccgttaccatcagggcacatctggattccttaacatcatggagccctagctaatttcttcgagcaaacagttcttgctcctctatttatttccacccttgcgctttgggtgttaatctcccatcctcgtggaaagttcttgatgttcctttccaccagtcctagggccaggctttaatcccattgatctcccactatctttaaagcctctgctgaccaccataccccactccagcctcactgagcatttttgtgtaaggttagtggtgcagttcatttagcaataaatactgttgtaccttttgcagtagacaactattaactttcatccttgattctcagttttttccaaaatacaagtgaatacctggtttccccagcaacattgtaagattgagagtaggaattcattgagattttaatgaattccatggattgtcttaagagctatctaaacttggaagaaaaataacttccagagcatctaaaattgaaaataaaagatcagaagcaaatgaaagatcaattccacacagcttttcctctcttagacgtccctcttctgccatatcctgtaaacatctgaagtgttctgagtacatttggagagaatatttaatgatcacactgtgattagacatgagtagtccctgccagtgggatgttcctgtcctttgcattttaaccacatgttctgtgctctctgtggtaaagataatctaacagtaataaaaacttatggagaaaattacccagagctcctttatcattacgatttttaatactctcttctaatccttatgcacatgtgtatggatttatgtactgcaaatcattgttttgtaatacattctcaaaaatgtgctttaggtttttacaactaccataatattttgtaattttccttcattactgtaatttgctaaaccatttctgttttggtagataattaggtagtttccagttctgctttttagaagatactacagagaacttctttgtgcatatttccttagaacaagttccagtagaagacttactcgcaaaagcagtggaattttttcttagtattttctgttacaggtacagaagagtgcatacaacacacagttttgtcgaatagttatgaagtgaacacttgtctaaccactgcccgagtcaagaaagaacatttctaaacatgtttgccaatttaatagatataaaggaagtatctcaaggttgctttaactgacatttctttaacacatgacaacatatttttatgggggaggggactagagagaaaatgacatatttttatgtgtgcttatttgtatctcttgaattctgtctgcatcttttacccattacactttcaaatacttgtgaaatcattggtcgagatgaattatggctataaataaaatttcactaatctaattatcactgatttagaaataatagttcaacccaagacatgc

SEQ ID NO: 438199 - DNA, 6875 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438200 - DNA, 6823 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438201 - DNA, 6691 bp, Homo sapiens
ccttaaaggaagaatcagtgtcttcatctctgggtccctaatgttcctttagaactggtatacatttgaaaacaaatatttgagtacacactatacagcttacactgtttttggcgctggggatacagctgtgaagaaattcagacacttttgagttaatggcttaatctaacctttgagatccttgtttttgttttgttttttctctctttacattgggttttcttgagtctgggtgctgttttgcagcttccattctttatattttgtcttactgttagtgtgtatcagagtaggaccatgtacgttttgttttcctgcataaattagataaagtattgtgtagtgtcaggcaggcagtcctaagaaggaatgccattatctccaacatttgttttgcctctcactgtagctaccacaaataaaagagattgtattattcctaggactttccaccttagaataataagctataatagtaagaattttgaaatagttttatcagaaaattgctagttgaatagcatcattcttacggtgtctctggttgggaaattatataattggggaaaataaacattattgaactctattataaaagacccactgacagagacatgttttaactttgtgtaattatatgcactagtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438202 - DNA, 6081 bp, Homo sapiens
ccattattggatcttttatactgtcccgtgtgataggcattatcttcattgcaggagctggagttaagagagattaaataatttacccaagattgcacaggagaattaagacttgaacctgtgattcttggctataaaacctggggtctttccagtatacttcactttctatctgacttcacaaatgcagaccattttaaggacaagcttttctgtagtgatgtgatctctcatctttcctcattttcttttttctgtagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438203 - DNA, 5835 bp, Homo sapiens
cgctcccggcttttttataagtgggctgagcttttctccttatattttactttttatcaaaaacatttaactctaaatttgcttgaatttaatattggttttaaatatctccagaaaagattacagtagcataaacagaagcaaggttgccttctttcacagtccctaactctcatccttgtagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438204 - DNA, 4495 bp, Homo sapiens
taagtcacctcgggaccttatttccttcttattggctgtacctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438205 - DNA, 6266 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctacaagaaacactgaaacatcctaacagcaaaacagctttttgcactgagcgtgaccattcagtctgattaggctgatgggaatggtgcaaagactactcagtaatccatttgaggatttattctgaaaaaag

SEQ ID NO: 438206 - DNA, 5078 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactgcactccagcctgggcgacagagtgagactccatctcaaaaaaaaaagaat

SEQ ID NO: 438207 - DNA, 1394 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtaggaagacttggaagaagtctcctgcttatcaggctttttgagggagggcgtggaggatggtagacactgccttataagtgttaggtgagtcataagatggaattgctgtacctacaaagcataatggtacacaacagtgaccagcaagtagaaggtacttaatacatggtttaacaaataaatgacttatggacatggaaagttgcccacaatatattaggtggatagagggggcaaataaaacagattacatacaaaaaaatatgtagagtgtgataccggtttctgaatgtgttcatgcatcaaaatgttgaaggtgggtatttctggtgggattgtgggcgtgtttttccctttagaataaacatgtttctttcttaatca

SEQ ID NO: 438208 - DNA, 743 bp, Homo sapiens
agcaccggaagccgctcccctgtgaggctgcggaccgggagcagcggccgcaggtccgggtctgtatgcgaggcggggccggtcggggaggggactcttaggcgcccgcggctctgctgacccgccgcgccttggctgtttttctttccctgcaggcgccatggctgcggagcggacccggccgctgcaaggctctggcggtccgagcgtgcctagtagctgtgaacccggcgcgaggtcccgggccccggggcgctcgctcaggtcagtgccgcgcggaacacgattccgagagcaagggacctgggagcaacgaatgggttgatgggatctggattttagagacgggaaaacagggttttggagttactgcctcctactgcctccatttccttagctgcgaaatgagttaacagtgatgtcccagggctaccaaacgtttgaaagacgatgaagtgtgatgaggtggtttatgaagtacaaagcgctatactgcgccataattgtgggtatgccatgaaaacaggtgtgtatgtggggtgctgcttgaagtaaagcaaagataacaatattaatgctaagtaataatggtaactgacatttactgtaggcttacagcgtgccgagtactgtgctaaacgctttacttgcactgtcttgtttaaccctcataaaaacccttgtaggtaatgctcttggctgtattttacaagtgaggaaacagggcatgagacaggtgaagt

SEQ ID NO: 438209 - DNA, 2131 bp, Homo sapiens
  misc_feature (425)..(425): n is a, c, g, or t
gctcaaactccctctttcaggaaacacgtatgaggtttctactctgtatcaggcatcgtgctggagcctggggatatgtagattaatcgtgtatggtcactgtttctgggagctcaggttccctaggatagtacacacacaaaacccaagaggtgtcatgaaggaagcaccaagaaggaagaagttctacttaagggtgataaccaaggttccatagaggaagtaactctccaagagatttgtaagctagtagaaggattctagatacagactttctataaactgatactctttgtttgctggctctaggttgctaacctagatgcatggttggtggaactgtatcactcatcgggtctttattaaatataggaacacagaagacactgctagaacttgaaggcaaaaatcattaaacaactganaacacaaaatgagcaggttggtggtggtgccagcctggtttttaatctcttcaaatccacacaaagaacagcaactaggccaggcgcggtggctcacgcctgtaatcccagcactttgggaggccgaggcgggcggatcacgaggtcagaagatcaagaccatcctggctgacacggtgaaactccgtctctactaaaaatacaaaaagttagccgggcatggtggtatgcgcctgtagtcccagctactcgggaggttgaggcagaagaatcgcttgaacccaggaggcggagtttgggaggttgctgtgagctgagatcatgccactgcactccagcctgggcgtctctgtctcaaacaaacaaacaaacaaacaaaaaacccagcaactgaatagcaaaaccaagggcccagacagtactttcaacaaagctaggtacaaggtaacttcatgagccccagaatacagtagttgaggcgaaatacctattgccacaagaacatttttgtaggaggaaaatgaaggaaggaaaagagatagtatatgagaggcctgagaacaggagaatccaaaataggcaacaggtgatcaatggagagttgggctgccaatcctaaaatgtcagctgaagctgggagaggctctccaacagtggatgagaacaaggacctaaggcaagaacgcctgaaagggctggagcactgtagcccttataaacagttgaggctgatcggctctcttttaggacaaggccccacaccagggaaaactcctggggctaaaactcctgggagcaggacagggacaagagaggaaagtaagagatggcccagactcaagaaaggataaagacagaggcaggaaatgccagaaagcaacttgcaatatgtttgaatccatacataagagaagagggactgctctgagaaggttgaaaagcttgcctgaacatacactcattccaaaaagtcaggaaaacaaattttacataaaaataatataaaagtatcaagatcaaattctatacacagttattaagaaaaaaatgcgaagaaggagcagattaacatccttacagacaatgaaaacacaccagggagacaccataaaacagaccaagactaacttaaaaacaaatacatcagcctgggcatggtggttcacacctgtaatcccagcactttgggaggccaaggcaggctgatcacttgagcccaagagttcaagaccagcctgggcaatatgatgcaaccccatctctacaaaaaaaaaaaaaaaattagctgggcatggtggcatgtgcctatagtcccagctactcaggaagctgaggtggaaagatcacttgagcctggaaggtccaggctgcagtgagccatgtttgagcactgactccgggctggacaacagagtgagaccccatctcaaaaataataataataacagataaacagataatgatttaagagataaaagacagtgaaaaagaaagatatgtttaaataaaaaggaaatgaagagataaacaagatttgagggaaattgacaaatattgaaagcagcaaagatcaaacatacaggtaataggagttcctaaagaagaaaatcaagtaagggaggaacagaacaaatgccaaaagatataattcaagaaaacatttcagaaatttaaaaatgttgaaactacaattgaaagtataccaa

SEQ ID NO: 438210 - DNA, 6915 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438211 - DNA, 7177 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtcagtgccgcgcggaacacgattccgagagcaagggacctgggagcaacgaatgggttgatgggatctggattttagagacgggaaaacagggttttggagttactgcctcctactgcctccatttccttagctgcgaaatgagttaacagtgatgtcccagggctaccaaacgtttgaaagacgatgaagtgtgatgaggtggtttatgaagtacaaagcgctatactgcgccataattgtgggtatgccatgaaaacaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438212 - DNA, 9529 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccccccaaccacttcagacattttatccaaccaatgcagggacttttcaaaagtcagtgtgtttttgaaaatagaacaaccccttgagtgatctgaggtggctctgtttttttactgtttctgcatcttctagaaggtaaactcaacaatataaccatttctgaaggtgatccaaaaagcaaaacaataaaggtaaaacacaaggaaataattttggtgaatttcatgaatagttgcaaatgaagggatggggtgggtaaaagtcccattttgcttccagaccttggaatagtcttcctctcttttgcccaaggatgtgtctatccagcacatctttgcatgagttctttcttactaacttaaacttacggggcttcttgtcatttgagtaccacggccctgcacctttgatcccctgacagcatcattaagggcagattgtcattcctgttttacagatgagaaagctgtggcttggtaaagtgattcattgcctagaggagttatagtaagtggtgaggctgaagccctgattttcagcccccacacacctggattttttccatgttttcatgtttgtctgttctttctgtatttcaagtctcttcaaatcccgactgctgccttctgccttcaccacttgtgtgcactgttcaacctgtcttatgctttgcttccagggagtctccccaaccacttctttgagcacttacttgctcttgttcaatcttggtaactctccgttaccatcagggcacatctggattccttaacatcatggagccctagctaatttcttcgagcaaacagttcttgctcctctatttatttccacccttgcgctttgggtgttaatctcccatcctcgtggaaagttcttgatgttcctttccaccagtcctagggccaggctttaatcccattgatctcccactatctttaaagcctctgctgaccaccataccccactccagcctcactgagcatttttgtgtaaggttagtggtgcagttcatttagcaataaatactgttgtaccttttgcagtagacaactattaactttcatccttgattctcagttttttccaaaatacaagtgaatacctggtttccccagcaacattgtaagattgagagtaggaattcattgagattttaatgaattccatggattgtcttaagagctatctaaacttggaagaaaaataacttccagagcatctaaaattgaaaataaaagatcagaagcaaatgaaagatcaattccacacagcttttcctctcttagacgtccctcttctgccatatcctgtaaacatctgaagtgttctgagtacatttggagagaatatttaatgatcacactgtgattagacatgagtagtccctgccagtgggatgttcctgtcctttgcattttaaccacatgttctgtgctctctgtggtaaagataatctaacagtaataaaaacttatggagaaaattacccagagctcctttatcattacgatttttaatactctcttctaatccttatgcacatgtgtatggatttatgtactgcaaatcattgttttgtaatacattctcaaaaatgtgctttaggtttttacaactaccataatattttgtaattttccttcattactgtaatttgctaaaccatttctgttttggtagataattaggtagtttccagttctgctttttagaagatactacagagaacttctttgtgcatatttccttagaacaagttccagtagaagacttactcgcaaaagcagtggaattttttcttagtattttctgttacaggtacagaagagtgcatacaacacacagttttgtcgaatagttatgaagtgaacacttgtctaaccactgcccgagtcaagaaagaacatttctaaacatgtttgccaatttaatagatataaaggaagtatctcaaggttgctttaactgacatttctttaacacatgacaacatatttttatgggggaggggactagagagaaaatgacatatttttatgtgtgcttatttgtatctcttgaattctgtctgcatcttttacccattacactttcaaatacttgtgaaatcattggtcgagatgaattatggctataaataaaatttcactaatctaaaaaaaaaaaaaaaaaaaaaaaaaaaaaaaaaaaaaaaaaaaaaaaaaaaacaaaaaaaaaaaaaaaaaaaaaaaaaaaaaaaacaaaacaaacacacaacaaacaagaaaaaacaaaaaaaaaaaaaaaaaaagggggggggggcgacaaaatcatcacacggggggggagaaagtcagccccgctgttgtaagaggggcccgccaaggaagaggagcaacttaaaagagaaaccgacgcgggacgggcaaacaacaacagcaggaggcgaaagacaacacgcggtggagcaagggagaggaaacacccacccgggggggggaataaaaggacaacaaccaggataaaagccggacagaaaaaaaacaagagagatgagagcacacacagccggcggcgagaagaggcgagaatgaaaaaaac

SEQ ID NO: 438213 - DNA, 7627 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccccccaaccacttcagacattttatccaaccaatgcagggacttttcaaaagtcagtgtgtttttgaaaatagaacaaccccttgagtgatctgaggtggctctgtttttttactgtttctgcatcttctagaaggtaaactcaacaatataaccatttctgaaggtgatccaaaaagcaaaacaataaaggtaaaacacaaggaaataattttggtgaatttcatgaatagttgcaaatgaagggatggggtgggtaaaagtcccattttgcttccagaccttggaatagtcttcctctcttttgcccaaggatgtgtctatccagcacatctttgcatgagttctttcttactaacttaaacttacggggcttcttgtcatttgagtaccacggccctgcacctttgatcccctgacagcatcattaagggcagattgtcattcctgttttacagatgagaaagctgtggcttggtaaagtgattcattgcctagaggagttatagtaagtggtgaggctgaagccctgattttcagcccccacacacctggattttttccatgttttcatgtttgtctgttctttctgtatttcaagtctcttcaaatcccgactgctgcacattcactgccagcagatctcgtcgtgcaacatgataaatgacaggggcacctcctc

SEQ ID NO: 438214 - DNA, 6081 bp, Homo sapiens
tgcttctgccgtctacggccataccaccctgaacgcgcccgatctcgtctgatctcggaagctagagcagggtcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438215 - DNA, 5897 bp, Homo sapiens
ttcaaactatattacaaggctaccgtaaccaaaacagcatggtactggtacaaaaatagacacatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagtcttgctctatccccaggctggagtgcagtggcgtgatctcggcttactgcaacctcagcctcctgggttcaagcgattctcctgcctcagcctcctgagtagctgagactacaggcgcgtgccaccacgcccagctatttttgtatttttagtagagacgaggtttcactatgttggccaggatggtcttgatttcttgacctcgtgttctgcccgcctctacctcccaaagtgccgggattacaggcgtgagctgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttgcctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcacttttttgacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatagtggggtgattgtggaacaagatgtctctaagatgagaagttattttcttgcatcatagaagcactctttttacccgtgagtgattgtgttaactataaatcatttatatctgtacattaaagcagattccctcaattaggcaaatttggttagccaagcccaagttattgtttgtacttgaaagtaataaagctgcatttccttaaaaata

SEQ ID NO: 438216 - DNA, 5600 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcacgcagtgcacaatcatttatctatgttttgccaggggccagggctcggggtgggggagggcttgttttattgacatacaacgcagcatgctaatggggtacaccattgacttcatttgtacttagttatgttggtcagtgttagaggatgcattttgggttcatctttcttgagtggagtattggttttaagtaaagaaagttaaatgatccattaatctgctaattggttgcctatgaaatcacattgtctgttattaaagctttttaccatagcctttttttcttttgaagttgaagcaaaggtgctatgatgttgttacagcaactttcctcacacggggtttagctcttataagagccagtgttaaaacttccaccaaataccagtttataaacttccaccaaataccagtgctaaggaaagtctgtcttccagttcaaatccaattctgtaaattgaatgttagcaactcattctaaaccttatatcttggcagagtcaaggttggccatgtttaagatgtgagcgagttctgtagtttttgttgccatgtcggggaagctagtccccggcagcctggatgactgcacagcggtgccctggtatagcagaaaagagcagtgagctggaaggttagagaccgggcctcttaccctggaactctgcaccctctctgggtcccagcttccttgtctgtacagccaggtatgaagctcagtgatttctaagattctttctggtccttcacctactgaaatgtgtaaaagttgatcatgtatttttgtctgatccctgattcatggtttctttcaggtcggataatatttaaatgaaatgactgttacagagttttctataagaacatcaattatatgaaaaggatgaataaaagggaaatgtagaaaatatagctgattccacttagacagtttaagtaattggttgaagaaatgctgatagaagccatggtttaaatagggacacagtatgctatactagaaggatacctgaacccaacctaacttcctcctttgcctctaacttaatctgcagcctcaggcaagttaactttctcttctaagaccatcattttcttcatcttttaagtgagggaattgtcctagatgagggctcacaaacccaaatgcctaagggagccgtgcaggtaacataaatgagtaaaacattctggggaggattgtgctgtcccctggaaagttgatctaatagggcagttattcagctctgttttgtcattaggagaagcaagcccagggttggcaggtcttcacattgtttcaggaggagctagaaatccagatttttatttgaaatcctggatttttaaaacgttacaactgattaaagaaaatttgaaataaggtgagccaaacaaaacatgtccctgggttgccagattgtgtcctcctccctctctaaagttaggtaattttgtgattcagcagtggaaatgttagtggtcacaatcagggagagagtagagggagcaagcagtagaaaaatctcagccgctcttcagctgtctccccttgtattacaagggtggtggggagggatgtatttcattcacagaccaataggaaggtagtttgaagatgaacataagaattggaacctcagtgacagcttatgtctgggaacatgagttattccttcttgctgactccagtataaagcatatccattttacaggtgagaaaaagggttgctggcagagctgagaatgatgtgaactctagagtggggacctatctcttgcagaatctgcattagcatagagccagactctggacctctgagtgctgtgaagttgatagaaattaatggtgaatttcaaggacagatatcattaatatccatgttgaaactctgtggggtttaagcaaaagaacaatatcttcccccatcccacaaaatctgggtttaatctatctcacattgagttctgtgcatcagctctgcttagtactctagaaatagaaccggaatcacaactgaatctattttgcagaagccccaggagactttgggcactgatgatggtaaatgactttttactctattattatttctttttttttgagacagagtttcgctcttactgcgcaggctggagtgcaatggcacgatcttggctcactgcaacctccgcctcctgggttcaagtgattctcctgcctcagcctcctaagtagctgggattacaagcatctgccatgacacccaactaatttttatatttttagtagagacagggttccaccatgttggccaggctggtcttgaactcctgacctcaggtcatccacctgccttggcctcccaaagtgctgggattacaggcgtgagccaccacgcctggccgagtttttactttttatcgagcctgaacagataactattactgatctaatgaccatccccaccctacctcactttcagatctatccaatagcttcaaagggcaagtaattataatcatttgtgggaaaagttttattaaaaagtgacaaacttgaagctgtatatagtatgttctatttcagtttttagtggtgaatacagaagtcatcaaggtggtacttggtgccgctggaattttttttttttcctaggcagtcttgctctgtcatacaggctggagtacagtggcatcatcatgcagctggattttgacagcagaacttcaggcagtaattggagtcctaatgtcagttcttccttatggaggcctttatttggcctgagattttattcaactactttatagatgctgggtttattcatactatcgccagtttttataaaaatggaaaactagctcatcctttttgcaaaagaaagcaaagtggggagtcagaatgagaagtggataggggataactaaaactattctttactctcctttcattgcctttgagagctagctcttgcacacactgactttggcttccttagcgcataggtaagggaattgcctttccctcttttgtgaatattctcatttctgaaaaattctaagtcatgagaagataagccctatcctttcttacaaggattggatttcttgggtgacactgtggtgtggtggaagccagcggcttctttcaggttcataaaggccatcataacaacttcaggcttcatggtgtggacagggatccaggagagctgagtggatgtgtgaagtttctgatagattctgtcatcattccaaaggaatgtagtttcctccagctcaatcatttgaagtaatacacattgccaaatctgactgtaacctgacattttagacctattggagaaataggaagaaagcccctccagtggaaggactggacttggaagaagttctgcaggaaggtgcatgcaattggatagctgttcatgagtgaaacgtggggaacattgctatgaaattgtaaggtttgcacttcatttttcgtagtttaaaaattgctctgttctggctgttgaaaacacttggtgtgaggtttgaatgaggattatataatcattctagtattcataggaaaatgattactgctctctatttgtaaaacaaaagaaataactttcggaaacagtattttagacatgaggaaattgtttgtattaggcattttgatctaacagaatcagctaaggatagtggatcctggctttacacatttctttgaccaaacccagctggcaacttgaagttgttactgtgtggcttccagattgcctagaggtgaatcctaccaacatcactgttttttttgttttgttttgttttttttgtatgtttttgagacagagagaatcgcttgaacccaggaggcggaggttgcagtgagcggagattaagccacctgcactccagcctgggcgacagagtgagactccatctcaaaaaaaaaagaat

SEQ ID NO: 438217 - DNA, 1690 bp, Homo sapiens
agcaccggaagccgctcccctgtgaggctgcggaccgggagcagcggccgcaggtccgggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacagggtcagatgacttgtctgcaaagctgtgggatgtgagcacagggcagtgcgtttatggcatccagacccacacttgtgcagcggtgaagtttgatgaacagaagcttgtgacaggctcctttgacaacactgtggcttgctgggaatggagttccggagccaggacccagcactttcgggggcacacgggggcggtatttagcgtggactacaatgatgaactggatatcttggtgagcggctctgcagacttcactgtgaaagtatgggctttatctgctgggacatgcctgaacacactcaccgggcacacggaatgggtcaccaaggtagttttgcagaagtgcaaagtcaagtctctcttgcacagtcctggagactacatcctcttaagtgcagacaaatatgagattaagatttggccaattgggagagaaatcaactgtaagtgcttaaagacattgtctgtctctgaggatagaagtatctgcctgcagccaagacttcattttgatggcaaatacattgtctgtagttcagcacttggtctctaccagtgggactttgccagttatgatattctcagggtcatcaagactcctgagatagcaaacttggccttgcttggctttggagatatctttgccctgctgtttgacaaccgctacctgtacatcatggacttgcggacagagagcctgattagtcgctggcctctgccagagtacaggaaatcaaagagaggctcaagcttcctggcaggcgaagcatcctggctgaatggactggatgggcacaatgacacgggcttggtctttgccaccagcatgcctgaccacagtattcacctggtgttgtggaaggagcacggctgacaccatgagccaccaccgctgactgactttgggtgccggggctgcgggttttgggtgcaacctctgcggcagccgactgcatgaaccaaagttctcacctaatggtatcatcaccagacgcgcttaagtaccgccga

SEQ ID NO: 438218 - DNA, 966 bp, Homo sapiens
agcaccggaagccgctcccctgtgaggctgcggaccgggagcagcggccgcaggtccgggtctgtatgcgaggcggggccggtcggggaggggactcttaggcgcccgcggctctgctgacccgccgcgccttggctgtttttctttccctgcaggcgccatggctgcggagcggacccggccgctgcaaggctctggcggtccgagcgtgcctagtagctgtgaacccggcgcgaggtcccgggccccggggcgctcgctcaggtaaatttttccataaccttatggagagaaaggactttgagacatggcttgataacatttctgttacatttctttctctgacggacttgcagaaaaatgaaactctggatcacctgattagtctgagtggggcagtccagctcaggcatctctccaataacctagagactctcctcaagcgggacttcctcaaactccttcccctggagctcagtttttatttgttaaaatggctcgatcctcagactttactcacatgctgcctcgtctctaaacagtggaataaggtgataagtgcctgtacagaggtgtggcagactgcatgtaaaaatttgggctggcagatagatgattctgttcaggacgctttgcactggaagaaggtttatttgaaggctattttgagaatgaagcaactggaggaccatgaagcctttgaaacctcgtcattaattggacacagtgccagagtgtatgcactttactacaaagatggacttctctgtacaggtaagagatgttgaaactgttttttgggttttgttttgtatttcatagggtgtaatcttgaaccagtcttgagctttgagaatgacaagtgttgattatatgagatatgtacagtgactttttttctctaatcctgagtggttccccccccttatcctcttccttctctctagagaacacaatcatttttat

SEQ ID NO: 438219 - DNA, 769 bp, Homo sapiens
gcgggctcatgtctcaggcctcaagggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438220 - DNA, 2722 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438221 - DNA, 2783 bp, Homo sapiens
tgccaggaggggcaaggacagctgaggacgactgaacctgtgggcatgaggcaggaacgacagagcagggcatgccaggcagcaggcaccatgtgcaaaggcatggcagagcagagcttgttgggcaccagggcacaggctgcccagcacttggcccttgtccaatggggaaatggagtccttgtctccgcaggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438222 - DNA, 2287 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438223 - DNA, 1238 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438224 - DNA, 2311 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccaggtgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438225 - DNA, 2649 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438226 - DNA, 1628 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgaggcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438227 - DNA, 1674 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctctaaaaaaaaaaaaaaccaacccaaaaa

SEQ ID NO: 438228 - DNA, 572 bp, Homo sapiens
tgccaggaggggcaaggacagctgaggacgactgaacctgtgggcatgaggcaggaacgacagagcagggcatgccaggcagcaggcaccatgtgcaaaggcatggcagagcagagcttgttgggcaccagggcacaggctgcccagcacttggcccttgtccaatggggaaatggagtccttgtctccgcaggctccatctatgagatctctgggaatgagtgctgcctctccacgggggacctgatcaaggtcacccaggtccgcctccagaaggtggtctgtgagaacccgaagaccagccagaccatggagctcgcccccaacttccagggtaaggtgggcacctctgcctccccatgtgccctggcactctcctggcacacccgcaggctgctcgtgggcttgccacgtccagcagtcactccctcccctcggggtttgctcccgaggccctcacattcaccacaacccagcctcaagggtggggatgtcctcagagggtcggcaatgccctggactcagagaggttgcaccctctccctctcagtctctggtcacacctgcctctg

SEQ ID NO: 438229 - DNA, 343 bp, Homo sapiens
cctaagtggaaaatcccaggaacaccctgtctccaacccccaaccctatcctcattttctaccctgatccctttctcccttgccagagaatatttcacatgcatgtagcaaaaacaccaggggtcttgagaggtcatagcctgaaaaggaagtagagagagaagcagaggaagtgacacttaacgtgaatgaccgtttttcatggactctgcttccccatttcttgagaccctgatgatttctgctttttctcccaaagtcttctcaagtcttaggattgcagcaacacgctcggctgcccaaacccaaggcgaagaccttgccagagttcatcaaggatggc

SEQ ID NO: 438230 - DNA, 2581 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438231 - DNA, 1649 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438232 - DNA, 2155 bp, Homo sapiens
ggctgtactggtccgggattttgggatccgcggggaccatggagccggtgccgctgcaggacttcgtgcgcgccttggaccccgcctccctcccgcgcgtgctgcgggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacacggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438233 - DNA, 1830 bp, Homo sapiens
tgccaggaggggcaaggacagctgaggacgactgaacctgtgggcatgaggcaggaacgacagagcagggcatgccaggcagcaggcaccatgtgcaaaggcatggcagagcagagcttgttgggcaccagggcacaggctgcccagcacttggcccttgtccaatggggaaatggagtccttgtctccgcaggctccatctatgagatctctgggaatgagtgctgcctctccacgggggacctgatcaaggtcacccaggtccgcctccagaaggtggtctgtgagaacccgaagaccagccagaccatggagctcgcccccaacttccaggcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438234 - DNA, 1643 bp, Homo sapiens
  misc_feature (42)..(42): n is a, c, g, or t
gcccactctataggatcccccgccctcacagtcctttgtggncaccacccggagtggccggcctggctggaaagcacctaggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatctctgtagcaccaagcctgatagatctgtatatggtaaacaggggtttaaccacatgtggttaacatggattaatgtgggaatttggcttcaagaacacaaccttaggaccttgggccccaaaagctggtggtgaaatgagaggagccaatttaagaagacccttatggagacctgaggctgcagaaactggtaggtttcatcaggtggttaaagtcgtcaaagttgtaagtgactaaccaagattatttcattttaaaaccacagaataaaaatgacacctgagcttctcta

SEQ ID NO: 438235 - DNA, 2479 bp, Homo sapiens
ggctgtactggtccgggattttgggatccgcggggaccatggagccggtgccgctgcaggacttcgtgcgcgccttggaccccgcctccctcccgcgcgtgctgcgggtctgctcgggggtctacttcgagggctccatctatgagatctctgggaatgagtgctgcctctccacgggggacctgatcaaggtcacccaggtccgcctccagaaggtggtctgtgagaacccgaagaccagccagaccatggagctcgcccccaacttccagggctacttcacccccctcaacaccccacagagctatgaaaccctggaggagctggtctctgccacaactcagagctccaagcagctgcccacttgcttcatgtcgacccacaggattgtcacagagggcagggtggtgactgaggaccagctcctcatgcttgaggctgtggtgatgcacctcgggatccgctctgcccgctgtgtcctgggcatggagggtcagcaggtcatcctgcacctgcccctatcccagaaggggcccttctggacatgggagcctagtgcccctcgaactctgctccaggtcctacaggatccagccctgaaagacctcgtcctcacctgccccaccctgccctggcattccctgatcctgcggccccagtatgagatccaagccatcatgcacatgcgcaggaccattgtcaagatcccttctaccctggaggtcgacgtggaggacgtcaccgcctcctcccggcacgtccactttatcaaaccgctgctgctgagcgaggtcctggcctgggaaggccctttccccctgtccatggagatcctggaggttcctgagggccgccccatcttcctcagcccgtgggtgggctccttgcaaaaaggccagaggctttgcgtctatggcctagcctcaccaccctggcgggtcctggcctcaagcaagggccgcaaggtgcccaggcacttcctggtgtcagggggctaccaaggcaagctgcggcggcggccaagggagttccccacggcctatgacctcctaggtgctttccagccaggccggccactccgggtggtggccacaaaggactgtgagggcgagagggaggagaatcccgagttcacgtccctggctgtgggtgaccggctggaggtgctggggcctggccaggcccatggggcccagggcagtgacgtggatgtcttggtttgtcagcggctgagtgaccaggctggggaggatgaggaggaagagtgcaaagaggaggcagagagcccagagcgggtcctgctgcccttccacttccctggcagtttcgtggaggagatgagtgacagccggcgctacagcctggcagatctgactgcccagttttcactgccttgtgaggtcaaggtggtggccaaggacaccagccaccccactgaccctctgacctccttcctgggcctgcggctggaggagaagatcacagagccattcttggtggtgagcctggactctgagcctgggatgtgctttgagatccctccccggtggctggacctgactgtcgtggaggccaaggggcagccagacttgccagaggggtctctccccatagccacagtggaggagctgacagacaccttctattatcgtcttcggaagttaccagcctgtgagatccaagcccccccacccaggccccctaaaaatcagggcctcagcaagcagaggagacacagcagtgagggaggcgtcaagtcttctcaagtcttaggattgcagcaacacgctcggctgcccaaacccaaggcgaagaccttgccagagttcatcaaggatggctccagtacgtacagcaagattcctgcccacaggaagggccacaggcccgctaagccccaaaggcaggatctagatgatgatgaacatgattatgaagaaatacttgagcaatttcagaaaaccatctaagtgctggaggaaccacgcttcctaactgctgcttctcagggaatccgacaccagccaaccattttaagcctctaaaagacctcgggcaagtctcacagaaactgagctgcagacggggagtagctttgtggaaactgatttgatggacactgcaccagcttccttcaggttctagattcttgctacttagggcgggctggtttggacctaacatctcgcacgtgactccctcagcctcagagccttgggatgcagagcagctggcagggttcctctcaatcctgcaaccccagctgtcccaccggtggatgcagaggggaatccgaggccatcaaccttggtgacagcagcgcagtgccaatgctgatcacactgcatgggagattttgttaacgtctgccacccccactctcacccccaagctctaagcccccgggaggcctggactgtcttcctcatcgcgtccggcaccaacccccatacattcacacaggaaaacacatatgacc

SEQ ID NO: 438236 - DNA, 4964 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagaggaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438237 - DNA, 5041 bp, Homo sapiens
cctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438238 - DNA, 5252 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438239 - DNA, 5024 bp, Homo sapiens
tcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438240 - DNA, 5230 bp, Homo sapiens
cccagatttctcctccacggctgcacagtgccaggaagggaactgagaagaccaaagtggaggttctttaccttccccaacacactcggggccaggcgtggcacccacaactgcaaatgagacaattagggagaataagtgctggctgccctgtcagcccagagcctcagtctgcccagggcacccagactctgtgaggttcccacctgaagaagcagttccatcttccacaaggagcacaggaccaagagtccaggacccagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438241 - DNA, 4656 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagagggacgaccgaatagttgaggagcgccggggcctgccctagcggtcccccggtgtccgctgcccccgccccggtcgggggggggggcggtgtccccggtgtggccccgcgggggtggggggcggggggccccctcgcggggggagggcggggcccccgaccgcccggg

SEQ ID NO: 438242 - DNA, 4838 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtacccatcccagccacaccagggtctgtccggccaaccctcttccccagggaaaggagaaaagagaaaacaggctgggtgcggtgactcatgcatgcaatcccagcactttgggaggctgaggcaggtggatcacctgaggtcaggagtttgagaccagcctgaccaatgtggtgaaaccccagctctactgaaaatacaaaaattagccaggcatgatggtgggcacctgtaatcccagttactcgggaggctgaggcaagagaatctcttgagctcaggaggcagaggttgcagtgagctgagattgcgccactgcactccagcctgggtgacagagggggactccgtccca

SEQ ID NO: 438243 - DNA, 4361 bp, Homo sapiens
tgccaggattacaggcgtgagccaccacacctggccccacgggtgtcttgggggcactgtgcagccccctggctccctgtgccggacttggctggccaagccccccaccaactctcgtccagtggatagtgggggggcagccactgacagtttggggtatgggccctgcaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438244 - DNA, 3723 bp, Homo sapiens
agtctcacggtctgaagtgctcatgtgagcatctccacttctgctgcagtggaagattaaaggatcggtttgggcaggaggttgggggacatacacagggttaagtagccctgggctcccctcatgtggtcagaaactaagataaccctctcattcagaccagagaaaggacccaacatcagccacggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438245 - DNA, 2997 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaacccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438246 - DNA, 1256 bp, Homo sapiens
tctctggtgtttctgattttcctgcctttattctgtcttctcttgtccttctcattccacccacccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438247 - DNA, 2701 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcaggga

SEQ ID NO: 438248 - DNA, 1110 bp, Homo sapiens
cagcctgaccaacatggagaaaccccatctctactaaacatacaaaattagccaggcatggtggcacatgcctgtaatcccagttactcaggaggctgaggcaggagaatcgcttgaacccgggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgccctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438249 - DNA, 993 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatggtgagtgctgcgcgcggaggtctggtccggtccagcccagcctcgacggtcgcgggcagcggtgccgcgggtggcacccggggccgccctggctcgcggggggctgggcgccggctgcagcagcagcccccgcccggctctcggaaggcgtggagtcggggagcgcccgggcagagcgcggctctcccggcggcgctgcgcttggtcccgtcgggggcggccgcgccgagcttggttctggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgaggtcggtctggggctcgccttggggcactgtgggtggccacgcccggcgcattcggagggctaggttgcggccctctgggactgctgatccagctgtggcctaaggggtgtatgtggtggcgacgcagctaggtcggtgctgtcagagaccaggggacactcaggggccctgcacccagcgatccggtctccccagcatctcccggtgatgggtcctcagaggaggggcttgctgaggccgagtgctgactgcgataggcaggagtacca

SEQ ID NO: 438250 - DNA, 387 bp, Homo sapiens
gtaacttgagcgccggctgctagggaggctgggatggcctccaggtttcagacagggccctggactgggggcttttatactcatttcatctagtccttgaaactatgtgacaaaggaaggatggttgttatgcccagtccacagatggaaaaactgatgctcagaaaggtcaagttacctgctgaagggcacacagctagtaagtgactccaaaataggcgcctggccgacaccaggctgcttctctgtaattaatagtgtttacttggaggctcggggtcatgaccacaccagcttacattgacagcgcctttccagtctctccagcaccaagcacatcgaacttggttacagtgagcacttaataaatgcatggtgtggattctg

SEQ ID NO: 438251 - DNA, 654 bp, Homo sapiens
aaatccattacagtgactggcctgtgagcagctgggcagggtctgagttggggtctgctggcccctctgctcttgttgccgcacagctctgccttccccttctctagaaccttcaactttccatcttcgagcttgtctgctcatgacattgtctccctcaagaacacctgtctatatccagcctgagcatggtatttccgaagctgctcctcggaacatgagtactctagatcttaaagcccgctccatcaaaaaggaatgctgtggtccaataaggcaataaggctgggagaggctgtgtcttctcccctctctggaagaatcacggtgcctattattaccatattaaaggctctgaaaagtaccacagcagagacttttccaactttcccgaagctcatcctaagcttattggagcatggagccctgtgtgtggaaggccagtcctgtcttgcagggtgttcacgttaggagcgtggtttggaagcacagctgtggctccccttctcacccagcctgacgcttggaaaattgagtttaatctctggccatcattgttctgcacggggtgcctgttgcatttacctgagaccagtgcgcagaccttactgctgtgatgtgtatctcctcaggccaccgagatcatcctggaga

SEQ ID NO: 438252 - DNA, 533 bp, Homo sapiens
cttctggcggcaggactggtggcctgcttggcagcactgggcatccagtaccagacaagtaggtgccttcgtgttgcatggtgggcttgactcactcctgcacccggctccgtcagctcgggcgaggggggcttccctgcttaagccggggcagggctctgaggctaaggagggagccaggcccaggggggtctgggtgctgagatagaccaagacccgggaagtgggcagcgtgggtgatataaaggtctcgcacttgagtccacatcctgtcccagcaacttactggctgtgtgacctcggacaagtcacttattccctcagcctgtgtcttctctaatttaaatgggaaaacagtacccaactgggggatgggtctgcggactagagataacatatgtcccatagctggtgcctcgtaggacttcttcaactttagctctgggtactgttgttgctagaatgtggggtaattacacacataggctgacattgtctgctatctctagttccaataaaataacaataatgcc

SEQ ID NO: 438253 - DNA, 368 bp, Homo sapiens
gctccttccttgaccagcgctttcaggacgccgatgagaagttcatggaagtcatgtacgggaccaagaaggtgagcctgctactgcgtatgcctgaatatgggctgagcgcctactttatgccaaggtgtctatgggagcacaggaagggacctcagccagctgggggtgggtagaagcttccggaaggagtgcttatgccaagtaaagggtaaagaggagtcctagccactcagccaatttatagcaaaaagtagttgccagtagtgatgatagatgctccccttgaacaactcatgatcctcacaatgcctgtgaggtgagtactgttattagccccactttgcacaggggaccaccaatagtat

SEQ ID NO: 438254 - DNA, 412 bp, Homo sapiens
ccagctggcacagttgaatatacacatcagggaagaggctggagcagaaggtgtaaatgtgagagccatcagtgcgtagaaggtattttaagccatagggctaaacgagtgcacatcaagaagagggctcccctaggctgagcccaggcccagatccccagaaactagtccttgccccaacacgggggagctccctgagacctccataccagtcccctccttcaccacctgccatgggaacccctgagctttggttttctctcctcccaggcttaccagaactgggtgaagaagaacggggctgagcactcgctccccaccctgggcctcaccaataaccagctcttcttcctgggctttgcacaggtgagtccattaggaaaacatgccacacatggtacattctgccatc

SEQ ID NO: 438255 - DNA, 5018 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438256 - DNA, 4809 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctcctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438257 - DNA, 5092 bp, Homo sapiens
tgattacagatcttaggaggcaggtccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438258 - DNA, 5691 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatggtgagtgctgcgcgcggaggtctggtccggtccagcccagcctcgacggtcgcgggcagcggtgccgcgggtggcacccggggccgccctggctcgcggggggctgggcgccggctgcagcagcagcccccgcccggctctcggaaggcgtggagtcggggagcgcccgggcagagcgcggctctcccggcggcgctgcgcttggtcccgtcgggggcggccgcgccgagcttggttctggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438259 - DNA, 5156 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438260 - DNA, 4134 bp, Homo sapiens
cggtatgacgagcttcggtatgacgagcttcggtatgacgagctttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438261 - DNA, 3845 bp, Homo sapiens
ttccagaacaaagcatgggccccacatggtgctacctcccagcaagaaaggggttgggaaacaaagggctggggcccagcgagccccctgacttgtgttttccagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438262 - DNA, 3131 bp, Homo sapiens
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatcccctgtgaagagccggacatcccaggcacacgtgtgcgccacccttcag

SEQ ID NO: 438263 - DNA, 1173 bp, Homo sapiens
cccgggcaatattatcccccgcggaaaatatccgatcagcaccacaaacgctgatccagccagtgatgcactgaggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggag

SEQ ID NO: 438264 - DNA, 2935 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcaggga

SEQ ID NO: 438265 - DNA, 1496 bp, Homo sapiens
cgcgccaagggttaagggcccgcgcgggcgcggggagtgcagcctcaggccgtgattggctgcgccacccaggcccccgcgccctgccattggccccgcggcggccccgcccctccggcactcggcgccgaagccgcgagctcgcccgctggagctgagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtaagcgtgcctctcccctcccagcctgcctcccagcacggtccttcctgctccgtgtccacacccacacctgtgcaggtctttgaagctaggggagcccaggggtgtcagtgacctgatgggtgaaacaggcagaccctggcaggggagggacacccctaggctggctgtgtcactcaggcatcatggacacaaggggcaagagacaggtatcatttgtcctggttctagagagaggcagaggcagcaataacagctaccacaattcgcctggccctttatacatcacctgtgaccctcccattaaccctgcagatactgaacttcatttgcctcatctgtcaaacaggaattagttttgtcttgccttttacagaagagggtatcaggctcagagatgctaagtgatctgctcaaggtcacatagccagtaa

SEQ ID NO: 438266 - DNA, 1515 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatcttt

SEQ ID NO: 438267 - DNA, 931 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaaccaggtctcactgttttgccaggctggtcttgaactcctgtgctcaagcaatcctcccaccttggcctctcagagtgctggggttacagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttagcttga

SEQ ID NO: 438268 - DNA, 1454 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatcttt

SEQ ID NO: 438269 - DNA, 893 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccaagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 438270 - DNA, 1007 bp, Homo sapiens
gtattagtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 438271 - DNA, 832 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccaagaatgttttctctcttcaagattctcttttgaaagacatctaaaaagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 438272 - DNA, 674 bp, Homo sapiens
  misc_feature (7)..(7): n is a, c, g, or t
  misc_feature (17)..(17): n is a, c, g, or t
cctcganccaggtgccngatataatctcgtggtgcgccgttttttaagccggtccgaaaagcacaatattcgggtgggagtgacccgatttcccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 438273 - DNA, 860 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaagaatgttttctctcttcaagattctcttttgaaagacatctaaaaagaaaccaggtctcactgttttgccaggctggtcttgaactcctgtgctcaagcaatcctcccaccttggcctctcagagtgctggggttacagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacattta

SEQ ID NO: 438274 - DNA, 964 bp, Homo sapiens
tgaactgctaggtactccttttggcctaaggacacagtgaaaaatgtaccgagaccttggagagccacgaaccaagaaacttcagaaacctctgatatctgatcaagagttaagagacgtcagaatcatcacaactgacaaaaggtgctcccggattttgctctccagcttccggttcttggtctccaggctcctcactctgtccaagaatgttttctctcttcaagattctcttttgaaagacatctaaaaagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtacacattgttccacatcacttataattaaagaataagcatttattttacagtgattcttctttttaactatgtaaaaatttgcatacatgtgactgttctaactttaatactgccagagcttaatccttgatgtcctactgataaggtttgcattctaacaacacatgtaaataacatcactttaagagtaaaaaataaatagtaaacacatttagacatgagtgtgtgtgtgtgtgtgtgtgggtttagcttaaagagaaatatctaataaagcttttagcttga

SEQ ID NO: 438275 - DNA, 403 bp, Homo sapiens
ttacagaatgcatcccctaagcaaaggaagcagagtgtgtacacaccacccaccataaaaggtactgttcaggtactgtttcgggttgtcatgagtgctgaatcatggctggtcggccgtctgttctctaggaccacatatctgatgataagctagatctagtctcagctctacaacttaacagtgttatgttcagtaagatatcttatctacttaaaacttagtttcatcaagagtaaaatatggggttgaaaaagaaatagctagtgatctcagaatttcagtctagaaattcagtttccaaaataatgacaaagatttttttttaccgttattcgcatacttccttaaagagattttcccagaagccctaattactcttgccagtgttggcagatgatta

SEQ ID NO: 438276 - DNA, 618 bp, Homo sapiens
tatagagatgaagtctcactatgtttcccagcctagtctcaagctcctggactcaagtggtcctcctgcctcagccttccaaagtgcagggattacaggcatgagccaccgcacccagctcaactggttgttattgttaggttggtgtttttgcatggcaatgccatccgcctgacatattgattgtgcaacaatcaatatgttgcacaaaatatctactgagccttgtaacagcttcctaaatccaaggatagatcagaaactatattgtacttcatttaaggcactcatttttgcatttccattgcagatgtctggaaggttatacgatggatacagatacagatacattcacctgtcagaaagatggtcgctggttccctgagagaatctcctgcagtcctaaaaaatgtcctctcccggaaaacataacacatatacttgttcatggggacgatttcagtgtgaataggcaagtttctgtgtcatgtgcagaagggtatacctttgagggagttaacatatcagtatgtcaggtaagattctgtcttaattagaatgtgtaatgcctacatatacatatattgccaagcaagcagtatctataatagtaatccc

SEQ ID NO: 438277 - DNA, 260 bp, Homo sapiens
  misc_feature (26)..(26): n is a, c, g, or t
cggaaaatataaataatggaaaatanattttgagtgggcttaccctacctttcctactgcatcatattcatgcgatacaggatacagcttacagggcccttccattattgaatgcacggcttatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438278 - DNA, 4475 bp, Homo sapiens
acattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaagatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcgggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcatgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgttcatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaacaacaccagaaaaaaaaaaaaaaaaagaaaaaaagaaaataaaagagaaaaaaaaaaaaaaaaaaaaaaaataaaaagagagcagagtgaggcgcgagaggataaaaaaaaggagaggcgaggtgtcaggggggggggcggtggcggtggcgacatggagctatgcgagactggcgggatgggcgcggtgtggaagtgcggggacagaccgcatggaagcagaggaggtgtaccgggagtagaatcagggcagatagaggaggagctgtgtcgagaacaggggggacgagaggcataccgcgtagaaaggaggtgcagaggggagcagatgggaggagtgaggcggtatgtgtgcgcaccagcggcgatttgaggagcttcgaggtatcgctcgaacatgcatggaggtagattcggaggggcgagtagacaatggatggacgaagagggagaccggcatcctcgttgatacgccgagtttgaggtgcagggtaagcaacatacagtactatgcaatgcccagggggggcggccgccc

SEQ ID NO: 438279 - DNA, 1353 bp, Homo sapiens
ctgttgattggaatagtttcagaaggaatggtaccagctcctccttgtacctctggtagaatttggctgtgaatccatctggtcctggacttttcttggttggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438280 - DNA, 3817 bp, Homo sapiens
acattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaagatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcgggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcatgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgttcatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaagcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438281 - DNA, 1180 bp, Homo sapiens
ggtaagaatgggcaaaagtgaataagttacaagaaacaggcttttatccattggctattgggtttttatgtttctggttacttcgtgggattggtttctcaaaactcactcagggggattaccggtctgtcacgtagcagctttttaaaaaacgggacggtgcagtgtggttctgagtgcagtcttaataaagcccagtgctgtacgggtaaatataaacatttagtaacgtgaaaagcacaaggacacaatatgtccccttaatagcgggaaaaaccaatataagccctcccactccctactaccacggatggccaccaaagaattaaacaaaagtgcccagccaaccctatgttgatgggcagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438282 - DNA, 1500 bp, Homo sapiens
acattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaagatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcgggctctgacttaaggctttgtctagagaatagaaagtggagtggtgcctccccacagggtgaacccagttaagacgttgagccacatcgcactacatgcacaaggatggaatccaatgcaagctagacacaaagaagcatgccccgcagcgtaccaggacgcgggaccccgaagagatgtgaaatggccccgagaggaggaaaggccaagatgaacgaaaactgggaagagcagggaacacggcggcagtaacgaggactccagtaaagccacccatatcactct

SEQ ID NO: 438283 - DNA, 198 bp, Homo sapiens
tgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaattttgctgg

SEQ ID NO: 438284 - DNA, 427 bp, Homo sapiens
gaattgtaagatagatagaaaactagtggcagaatcaagagtaaaactcaggtctgatgcttctcagatctttccataagttagcacttgtttcccatgcctcttagttatctcaaagaatgacccccatccgtataaacatcacagataatgcccaggtatctgggactttcaatcctgttttcatcaactcctaaagagatgttagctcttcagttcaattttttcttttgaatctatttggttgcttttttttttttttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttt

SEQ ID NO: 438285 - DNA, 579 bp, Homo sapiens
ttacagtggatacatgttggagggtttcctgaggagtgtttgtttagaaaatggaacatggacatcacctcctatttgcagaggtaaggaaatatttgaatggttatttcttagtgaaactgcagggaaatgtgtatagaaatctgatttgtccagcaattaatatgcatactactttatttttccttggctttaaaatttcttttagcagctgtgtaattttcttttaatgttatggtttgagttttaaaagcacatagaactcttaggttctgtgcttgaaatgttgcaaaatagaaagaggtaatgaggcaccctagtattatatccttctaaaacttacacttttataataaaatatgatttttatacatcataataattatttcattcattctacaaatatttgctagaagtcgagaagtacgctagtacacacagataaaaccaaggaactaaataattgagttgttggatgagttgaccacaaactgttcagatttggactttttttttttttaatactttaagttttagggtacatgcacacaacatgcgggtttgttacatatgtctaca

SEQ ID NO: 438286 - DNA, 4038 bp, Homo sapiens
acattttcctgtaaagaagggcatgtcctgcaaggcccctctgtcctgaaatgcttgccatcccagcaatggaatgactctttccctgtttgtaagattgttctttgtaccccacctcccctaatttcctttggtgtccccattccttcttctgctcttcattttggaagtactgtcaagtattcttgtgtaggtgggtttttcctaagaggaaattctaccaccctctgccaacctgatggcacctggagctctccactgccagaatgtgttccagtagaatgtccccaacctgaggaaatccccaatggaatcattgatgtgcaaggccttgcctatctcagcacagctctctatacctgcaagccaggctttgaattggtgggaaatactaccaccctttgtggagaagatggtcactggcttggaggaaaaccaacatgtaaagccattgagtgcctgaaacccaaggagattttgaatggcaaattctcttacacggacctacactatggacagaccgttacctactcttgcaaccgaggctttcggctcgaaggtcccagtgccttgacctgtttagagacaggtgattgggatgtagatgccccatcttgcaatgccatccactgtgattccccacaacccattgaaaatggttttgtagaaggtgcagattacagctatggtgccataatcatctacagttgcttccctgggtttcaggtggctggtcatgccatgcagacctgtgaagagtcaggatggtcaagttccatcccaacatgtatgccaatagactgtggcctccctcctcatatagattttggagactgtactaaactcaaagatgaccagggatattttgagcaagaagacgacatgatggaagttccatatgtgactcctcaccctccttatcatttgggagcagtggctaaaacctgggaaaatacaaaggagtctcctgctacacattcatcaaactttctgtatggtaccatggtttcatacacctgtaatccaggatatgaacttctggggaaccctgtgctgatctgccaggaagatggaacttggaatggcagtgcaccatcctgcatttcaattgaatgtgacttgcctactgctcctgaaaatggctttttgcgttttacagagactagcatgggaagtgctgtgcagtatagctgtaaacctggacacattctagcgggctctgacttaaggctttgtctagagaatagaaagtggagtggtgcctccccacgctgtgaagccatttcatgcaaaaagccaaatccagtcatgaatggatccatcaaaggaagcaactacacatacctgagcacgttgtactatgagtgtgaccccggatatgtgctgaatggcactgagaggagaacatgccaggatgacaaaaactgggatgaggatgagcccatttgcattcctgtggactgcagttcacccccagtctcagccaatggccaggtgagaggagacgagtacacattccaaaaagagattgaatacacttgcaatgaagggttcttgcttgagggagccaggagtcgggtttgtcttgccaatggaagttggagtggagccactcccgactgtgtgcctgtcagatgtgccaccccgccacaactggccaatggggtgacggaaggcctggactatggcttcatgaaggaagtaacattccactgtcatgagggctacatcttgcacggtgctccaaaactcacctgtcagtcagatggcaactgggatgcagagattcctctctgtaaaccagtcaactgtggacctcctgaagatcttgcccatggtttccctaatggtttttcctttattcatgggggccatatacagtatcagtgctttcctggttataagctccatggaaattcatcaagaaggtgcctctccaatggctcctggagtggcagctcaccttcctgcctgccttgcagatgttccacaccagtaattgaatatggaactgtcaatgggacagattttgactgtggaaaggcagcccggattcagtgcttcaaaggcttcaagctcctaggactttctgaaatcacctgtgaagccgatggccagtggagctctgggttcccccactgtgaacacacttcttgtggttctcttccaatgataccaaatgcgttcatcagtgagaccagctcttggaaggaaaatgtgataacttacagctgcaggtctggatatgtcatacaaggcagttcagatctgatttgtacagagaaaggggtatggagccagccttatccagtctgtgagcccttgtcctgtgggtccccaccgtctgtcgccaatgcagtggcaactggagaggcacacacctatgaaagtgaagtgaaactcagatgtctggaaggttatacgatggatacagatacagatacattcacctgtcagaaagatggtcgctggttccctgagagaatctcctgcagtcctaaaaaatgtcctctcccggaaaacataacacatatacttgttcatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438287 - DNA, 1943 bp, Homo sapiens
tatagagatgaagtctcactatgtttcccagcctagtctcaagctcctggactcaagtggtcctcctgcctcagccttccaaagtgcagggattacaggcatgagccaccgcacccagctcaactggttgttattgttaggttggtgtttttgcatggcaatgccatccgcctgacatattgattgtgcaacaatcaatatgttgcacaaaatatctactgagccttgtaacagcttcctaaatccaaggatagatcagaaactatattgtacttcatttaaggcactcatttttgcatttccattgcagatgtctggaaggttatacgatggatacagatacagatacattcacctgtcagaaagatggtcgctggttccctgagagaatctcctgcagtcctaaaaaatgtcctctcccggaaaacataacacatatacttgttcatggggacgatttcagtgtgaataggcaagtttctgtgtcatgtgcagaagggtatacctttgagggagttaacatatcagtatgtcagcttgatggaacctgggagccaccattctccgatgaatcttgcagtccagtttcttgtgggaaacctgaaagtccagaacatggatttgtggttggcagtaaatacacctttgaaagcacaattatttatcagtgtgagcctggctatgaactagaggggaacagggaacgtgtctgccaggagaacagacagtggagtggaggggtggcaatatgcaaagagaccaggtgtgaaactccacttgaatttctcaatgggaaagctgacattgaaaacaggacgactggacccaacgtggtatattcctgcaacagaggctacagtcttgaagggccatctgaggcacactgcacagaaaatggaacctggagccacccagtccctctctgcaaaccaaatccatgccctgttccttttgtgattcccgagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438288 - DNA, 1082 bp, Homo sapiens
taccgagctgatacctcctagaagagtgtgattaaaatatgcggcgggcacggtggctcaatcctgtaatcccagcactttgtccacagctaagatggcagcagaatgctctgctgtctgaaaaggagttttatgttgatcagaatgtgtccatcaaatgtagggaaggttttctgctgcagggccacggcatcattacctgcaaccccgacgagacgtggacacagacaagcgccaaatgtgaaaaaatctcatgtggtccaccagctcacgtagaaaatgcaattgctcgaggcgtacattatcaatatggagacatgatcacctactcatgttacagtggatacatgttggagggtttcctgaggagtgtttgtttagaaaatggaacatggacatcacctcctatttgcagagctgtctgtcgatttccatgtcagaatgggggcatctgccaacgcccaaatgcttgttcctgtccagagggctggatggggcgcctctgtgaagaaccaatctgcattcttccctgtctgaacggaggtcgctgtgtggccccttaccagtgtgactgcccgcctggctggacggggtctcgctgtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438289 - DNA, 785 bp, Homo sapiens
tgtgtcaaacttgctgtagatctgcttgaggatctgcccagtccggcgtctgccgtcttccagcctccccatcagcgtttggatgccttcctctaggtcctttaggaggtgatagtcatcgctgtccgaggtgtcatacaccaggttgttggcgaacatactcctgaggaaccgcacgggctccagccacgactcgatgagcagcagggagatgcggagcagctctagattggatttctgttgcgtttcctccatgttggagggtgtcggaatagagtctgagaagcagaaggaggtctgggagtcatacagctgtttgccagtctccctgcttaaatggtggaaaatgtgtaagaccaaaccgatgtcactgtctttcttcttggacgggacataactgttccaggaaaaggaggactgggttttaaccactgcacgaccatctggctctcccaaaagcaggatcatctctcctcggtagtgcctgggcatcctggaacttatgcaaagaaagtccaacatggtgctgggtcttgtttagtaaacttgttacttggggttactttttttattttgtgatatattttgttattccttgtgacatactttcttacatgtttccatttttaaatatgcctgtattttctatataaaaattatattaaatagatgctgctcacaaaatgtacatattctgctgtctattgggaaagttcctggtacacatttttattcagttacttaaaatgatttttccattaaagtatattttgctactaaataaa

SEQ ID NO: 438290 - DNA, 480 bp, Homo sapiens
tgcttgtgagctctgtgcttatctgggttgtaggtgaggagataagagagagctgtgtgatcctttattaggggcttttcatatgagaggcacaagaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438291 - DNA, 207 bp, Homo sapiens
tttgtttgttttttaactgcatagttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagcaccaccaatacaggaagcaccaccaatacagctagcaccaccaagt

SEQ ID NO: 438292 - DNA, 3544 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438293 - DNA, 2792 bp, Homo sapiens
aggtcgcggccagaggaggagctcgctgccgggggacgctgggctgagcggccggcggcgcgggcccggcggcggcggcagcggggtccgggtccggagcgccacattcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438294 - DNA, 2564 bp, Homo sapiens
tgtttccctttgccttccactggtccttacagtttttcaggttgtttgtctcttcaagtcacagctggcgcccctcattccctgaagagcccgtcctggtctcttcctcctcttggagatatacatagaaactacacctttcccaggactgtgttatctgagaatgctttgccagccatagatatatttaaatccttttctttcttttttccattaaatggtggtaggtattttctttttagaaatgggaaggagtttaaatccatctgaggaaaaataagatgcagattgtgacttgaatttgagactttctaaatctacttttttttctggtaggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438295 - DNA, 2009 bp, Homo sapiens
gggaaagtctgtttctttttttcatcaagtcttttcaatcatgtgccattgtttttgtgaattaagcatcagtcataaatctagaagaacaatttggccttttctggttcacctaactgttatgatctctgtcctgtcacgggcatggcacggcccggctgcttcctgtctcagcactggagaccctctggcgtggagaggctgttgaggagacccaggaggttagggtggtgtctgcggtcccccttctgtgaggatgccctggctccactgctgtatgggagttgacagtgtgaccgcagggtgctgcctttgccagggtctcaaactctgggttaccatatgctttacttcctagaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438296 - DNA, 2610 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438297 - DNA, 1493 bp, Homo sapiens
gttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438298 - DNA, 2804 bp, Homo sapiens
  misc_feature (2801)..(2801): n is a, c, g, or t
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccccacacccacgtcttctatctcacgcagagttttcggtttggtgtggaaatagcttatgtgggagctactatcttggatgtttgcaagagagtcaggaaaaaagacttttgggttggaggaaancct

SEQ ID NO: 438299 - DNA, 2567 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggtggtgtggggttttgttttttcctaaatggaagtgatgacctgtgagaacgttgcagcacagaggaaacacagccagtgtgagggagcaggccgccgagtgatgcattgtgctggagtgggcgggggatggagcaccat

SEQ ID NO: 438300 - DNA, 1446 bp, Homo sapiens
gttagtacttgttggccataactggagtgtttgcctggtggttttctgttctttttcatagctggtaggcaggccgtctaagagaaaagaccaaataaatcaaaacgtaggttacagattgtagaataagtagatcaatagctggtcataatccagaaaatacgaaaccgtcctttcctgggcagcagatgtgtgcggtcctgctagcatatcagtctgtgatgtggagccccacagggcagcagcgaagctgacagtgccctgtccttgtggtgtttccagcctgggaggtcactagtgcttcctctgggtgctccctgcgtgccaggcgtgagtgctttgcatgcattgaagggtttcttctcctcagcagccacctgaagcaggcaccgtgccatctgcatttatggataaagacacaggcttagcgaggctgtcatttgctcactagcacagccagcagcacgggacggtggaaatacgcagggatgtttggggcaagttttcttcatgtcctctgtgttgcctgcctggcttataatgtgaatacacaatagttttctgaagattgagctggggataccttagcataaaataaaatccagaaatattctggaaatgtcattacaggcaatagttttgcatgtttatctgttaaatatatatatatttaaaaagcaattggactgtcagttggactgtcgatagctttggaggcagggaaaagttagaggaagtaagggagaacgggttaggcggggtttttctctctgggacttacagtgcatctaaagggttctcacagagccgccgctatcagtgtttccagtagaccctaacggaggtgtcgccatgactctctttctcgctctttctttctcaggagtacttcttgcaagcagagctgacaagcaacgtcttaaaaacaggacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438301 - DNA, 2223 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccgaggagtgtagtgctgttatctccacttacaggcaggaaacaaatacataggtttagccatttgtacttttatcctgtagcaacatattgtttacatataatgccgtcttgccaagaggggtgttctcatggaagtgaggcacagaaagtcaaaatgacttgcttaaagttcagagtctcacaaatcctgatcagttgtaggcttttcttggaagggagtgaggaagactcagccgaggcacacttgacccaggtctcctggatgtagaggcatcagggaactccaagggtccctccggggaccttctggagcccagcttcatggtggaatagcagtgtctgccgaaagctggttcctattctgggttggtacatgtgagtcctgaaagccatttccagtcagacatggaccatgcagaactttttcgctttaaaacattaacactcgcctgt

SEQ ID NO: 438302 - DNA, 1041 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacggtgagcaccaccaatacaggaagcaccaccaatacagctagcaccaccaagt

SEQ ID NO: 438303 - DNA, 381 bp, Homo sapiens
gtcctgctctcaagacagaggtgtgataagcctggacaaggcctgattggggatccctgggcatgtcttgtctggtcagagggtcacctcctttcctcctggcttccccaggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtgagtactgctgtcactagtggcactgttgctgctggcacggtcgcgtcttactgttttcccgtgacgatcacatgtgagcttacaccacagtgaccccg

SEQ ID NO: 438304 - DNA, 969 bp, Homo sapiens
gagcggtacatttgattgggaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttacctcccccctaagaggaggaacagatggtcttctgctgttcttttttttttttggagacagagtatggctctgttgcccaggctggagtgcagtggcgtgatctgggctcactgcaatgcccaccttctgggttcaagcaattatcctgcctcagcctcgtgagtagctgggactacaggccccaccaccagcccggctagttggtggtattttttggtagagatggagtctcaccatgtgggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttatggcttaagggacaggggagcagagtcctggttcttcctcaggggctctttattctgttctactttcaagcccgtacaatgggattttctagtcccagctctgccacgtgtaatgtcaggcaagccgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactg

SEQ ID NO: 438305 - DNA, 3388 bp, Homo sapiens
aggtcgcggccagaggaggagctcgctgccgggggacgctgggctgagcggccggcggcgcgggcccggcggcggcggcagcggggtccgggtccggagcgccacagtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438306 - DNA, 2638 bp, Homo sapiens
aactaagatctcaaatccaaaagtgatgagaaggagtccagggcgaacagaagggctcccctgtttcccaaatacaacttggaaagtttggattcagtccagacagtctgtagccagcagctggacccgtggctcggctttcctgactccttcctgctgtgattcgtattaaccatggcctgtgggctgtccctccctccctgtgcacctggcttgcagggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438307 - DNA, 3839 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttacctcccccctaagaggaggaacagatggtcttctgctgttcttttttttttttggagacagagtatggctctgttgcccaggctggagtgcagtggcgtgatctgggctcactgcaatgcccaccttctgggttcaagcaattatcctgcctcagcctcgtgagtagctgggactacaggccccaccaccagcccggctagttggtggtattttttggtagagatggagtctcaccatgtgggccaggctggtctcgaactcccaacctcagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438308 - DNA, 946 bp, Homo sapiens
gaaatgttcgagttcagagtcaagtgggaaacatgtatgtttttgtcatcttgtttctttccctttgaagcaccatctaacgtgtgctgtgtttttatcctagagtacattctgggcactgtgcacaaagccaaaggcctggagtttgacactgtgcatgttttggatgattttgtgaaagtgccttgtgcccggcataacctgccccagcttccgcacttcagagttgagtcattttctgaggatgaatggaatttactgtatgttgcagtaactcgagccaagaagcgtctcatcatgaccaaatcattggaaaacattttgactttggctggggagtacttcttgcaagcagagctgacaagcaacgtcttaaaaacaggcgtggtgcgctgctgcgtgggacagtgcaacaatgccatccctgttgacaccgtccttaccatgaagaagctgcccatcacctatagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttgataaaaaaaaaaaaattttatgtatttaaacttttattacaagatttcaattaaacaggcaccatagcactg

SEQ ID NO: 438309 - DNA, 3452 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgaatggtgtccttgaagcgagccgcctctgggataacatgcggaagctgggggagtgcacagaagaggcgcaccagatgactcatgacggctacttgaaactctggcagctgagcaagccttcgctggcctcttttgacgccatctttgtggatgaggcccaggactgcacaccagctatcatgaacatagttctgtctcagccatgtgggaaaatctttgtaggggacccgcaccagcagatctataccttccggggtgcggtcaacgccctgttcacagtgccccacacccacgtcttctatctcacgcagagttttcggtttggtgtggaaatagcttatgtgggagctactatcttggatgtttgcaagagagtcaggaaaaagactttggttggaggaaaccatcagagtggcattagaggtgacgcaaaggggcaagtggccttgttgtcccggaccaacgccaacgtgtttgatgaggccgtacgggtgacggaaggggaattcccttcaaggatacatttgattggggggattaaatcatttggattggacagaatcattgatatttggatccttcttcagccagaggaagaacggaggaaacaaaacctcgtcattaaagacaaatttatcagaagatgggtgcacaaagaaggctttagtggcttcaagaggtatgtgaccgctgccgaggacaaggagcttgaagccaagatcgcagttgttgaaaagtataacatcaggattccagagctggtgcaaaggatagaaaaatgccatatagaagatttggactttgcaggtaagggaagcagttggtttttacctcccccctaagaggaggaacagatggtcttctgctgttcttttttttttttggagacagagtatggctctgttgcccaggctggagtgcagtggcgtgatctgggctcactgcaatgcccaccttctgggttcaagcaattatcctgcctcagcctcgtgagtagctgggactacaggccccaccaccagcccggctagttggtggtattttttggtagagatggagtctcaccatgtgggccaggctggtctcgaactcccaacctcaggtaatctgcccacctcgacctcccaaagtgctagaattacaggcgtgagccactgcgcccagcctcttctgctgtttcttccctgtgtggaatatctttgagcaaggatggctttatggcttaagggacaggggagcagagtcctggttcttcctcaggggctctttattctgttctactttcaagcccgtacaatgggattttctagtcccagctctgccacgtgtaatgtcaggcaagccgtgcagccctcttctgggctctgtcccttcatgtgttagatccagacggtgggtggagccactctgtcctctgggatgtgattccgagaggcgttaactctcctgcaactaattttcgacttttcccctcgtctttttcttttttctgttcccgacagttgtctgttcccgacagttgtttcctctttcccccttttcctacaaaactgcactg

SEQ ID NO: 438310 - DNA, 2182 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggattcactacaacattttctattgcctatatcttcaggagaattcctgcactcaggccacaaaagttaaagaggagccatctgtctggccaggcaagaaaaccatccaacttacacatgaacaacagctgattctgaatcacaagatggaacctctccaggtggtgaaaattatggcctttgccggcactgggaagacctcaacgctggtcaagtatgcagagaagtggtctcagagcaggtttctgtatgtgacattcaacaagagcatcgcaaagcaggccgaacgcgtcttccccagcaacgtcatctgcaaaaccttccactccatggcctacgggcacatagggcggaagtaccagtcaaagaagaagttgaatctcttcaagttaacacccttcatggtcaactccgtccttgctgaagggaagggtggattcataagagccaagcttgtgtgtaagactctagaaaacttctttgcctcggctgacgaagagctgaccattgatcacgtgcctatttggtgtaagaacagccaaggacagagagtcatggttgagcagagtgaaaaactgactggtgagtgtctaagtgtctgaagtgttagggatctgaggatgggggaacaggggaagtgttagggatctgaggatggggaaacaggggaagtgttaggggtctgaggatggggaaacaggggaagtgttaggggtctgaggatggggaaacgggaagtgttagggatctgaggatggggaaatgggaagtgttaggggtctgaggatgggggatcaggggaagtgttagggatctgaggatgggggaacgggaagtgttagggatctgaggatgggcaaacaggga

SEQ ID NO: 438311 - DNA, 1630 bp, Homo sapiens
aggtcgcggccagaggaggagctcgctgccgggggacgctgggctgagcggccggcggcgcgggcccggcggcggcggcagcggggtccgggtccggagcgccacatgagacggtttaagcggaagcatcttactgccattgactgccagcatttggctcggagtcacttggctgtgacccagcccttcggtcaaagatggacaaacagagatccgaaccatggtctctatcctaaaccgagaacaaaaagagggagtaggggtcagggaagtcaaagatgcatccctgagttcttcctagcaggcaagcagccgtgcaccaatgacatggccaaaagcaattctgttggccaggacagctgtcaggactctgagggtgacatgatctttcctgcagagagcagctgtgcactgcctcaggaaggcagtgcagggccgggctcaccagggtctgccccgccctccaggaagcggtcttggtcctctgaggaagagagtaaccaggctaccgggaccagccggtgggatggagtttctaagaaagctccacggcaccatttgtctgtgccatgcacaaggcctagggaggccaggcaagaagcagaggacagtacgtctcggctctctgcggagtctggtgaaaccgaccaagatgctggggacgtgggtcctgatcccattcctgactcatactatgggcttcttgggaccttgccctgccaggaagcactgagccacatttgcagcctgcctagtgaggtcctgaggcacgtgtttgccttcctcccggtggaagacctctattggaacctgagcttggtgtgccacttgtggagggagatcatcagtgacccgctgttcattccttggaagaagctgtaccatcgatacctgatgaatgaagagcaagctgtcagcaaagtggacggcatcctgtctaactgtggcatagaaaaggagtcagacctgtgtgtgctgaacctcatacgatacacagccaccactaagtgctctccgagtgtggatcccgagagggtgctgtggagtctgagggaccaccccctcctccccgaggctgaggcgtgtgtgcggcaacacctccccgacctctacgctgctgccgggggtgtcaacatctgggccctggtggcggctgtggtgctcctctccagcagtgtgaatgacatccagcgactgctcttctgcctccggagacccagctccacggtgaccatgccagatgtcaccgagaccctgtactgcatagccgtgcttctctacgccatgagggagaaggggattaacatcagcaataggtaatgccccgggaggaggggaggggatgctgtgataatgggagagtcccagacacagcagcaggtccagccctgccacttagcagtgttagcacctggcaggctgtgggacccacctgctccacctcagtgtcatcttctgcaggagccaggggctgagagtttgatgtggaaaggctggtaagagcgccttatgaacgtgcagttctgagcggctgcgagataccactaaggctgattttaccatcatgggtcctgcagccttaggggaagcccctcgccaagagaagcctttcttattcacccgtggcctc

SEQ ID NO: 438312 - DNA, 466 bp, Homo sapiens
tggaaaatccatgttctttggttgttccccttagctctctctcttgtccatcaccacagagcaacaggaaggaaaacaaggggggctacctctgccactcctgtgcggagcagcgcatcgggcccctggcgttcctgacagcctccccggagcaggtgcgcgccatggagcgcactgtggagaacatcgtactgccccggcatgaggccctgctcttcctcgtcttctgaggacaaggcgcacgttctccgcagtgcagagcagcttgccgaggaccccgcgtgaagaaagccagcgaggggggcttctgctccctgagactctgggttcacccacagcactttctgaggaagaggacaccagcccaagctggacctgccatttctccactccctacagacagccagtctccacttgcctcccctctggatgtatctggtcagggaagtgggggatgttcttttga

SEQ ID NO: 438313 - DNA, 1277 bp, Homo sapiens
agtgactagtcattgattcgaagcatgtgagggtgaggaaatactgactttaacctttgtgaagaaatcgaacctccacccccttcctatttacctgacccctggggtttaaaggaactggcctccaagcgcgaccctgtgtgctggagccgcgggggaactttctgatggggcagcaccgccatctagtggccgtctgtcatcactgcagctggactcaggacccagatgttctttttcttcaattgttcagaaaattcctctcaactacagtggaaacctccagaaattcttttctagggagtttgttaagttagttacgcttaatgcttaatgaactttgccttaagtatttggtagtcttagagtcacggaattacggcgtgttcaagctaaaaaagcattagagatagtactatttgcgtaatgttgtcatctcttaatttgccagagggtctctcatgcagattttctgagccccattacttgacacttgtcactcccttccctgtgcctcagatgagatattcaagacatgccagccaatttaaacattagcctcagcaaaaacataatggagaagtcaaatctataaaggaaaattaagtataaagtcaattaaaaaataatttgagttgaattaccatttttaattctctatgccactgcccctctctgcccagaattggctgtccttgggagagctatttctgctatgtggctgacgtatttctccccacgttagaagatgcgacccgattcaagcacctccggaagtacacatacaactatgaggctgagagttccagtggagtccctgggactgctgattcaagaagtgccaccaggatcaactgcaaggtatggaggatgcaggcaggagggacctagagcccacagctttcccccagccctgttccagcgggcgcccaacacgcgaccttcccggagggtgtgtactgagcaaacgcagaacatcccagaactgttgtaatctgatcaaagcactgggactttgcctctgtttgtaagtcagccacattgctgagatgtggtctgcccccaccaaatttcgcaagtcagaagtattttcccgttaacttcccagatgcaataggaatccatgatctagattagcagcagtgtgggtctgtagatttcagcgtgagagaggcccagtaggtgagctatgggaggcaggcaactcggaatcgcactgtgaaatgcagtttttataatttaagtcaaacagaatctgttgctgaaaaatgaatgga

SEQ ID NO: 438314 - DNA, 14039 bp, Homo sapiens
tttgagactgcatagggctcggccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438315 - DNA, 14561 bp, Homo sapiens
agtgactagtcattgattcgaagcatgtgagggtgaggaaatactgactttaacctttgtgaagaaatcgaacctccacccccttcctatttacctgacccctggggtttaaaggaactggcctccaagcgcgaccctgtgtgctggagccgcgggggaactttctgatggggcagcaccgccatctagtggccgtctgtcatcactgcagctggactcaggacccagatgttctttttcttcaattgttcagaaaattcctctcaactacagtggaaacctccagaaattcttttctagggagtttgttaagttagttacgcttaatgcttaatgaactttgccttaagtatttggtagtcttagagtcacggaattacggcgtgttcaagctaaaaaagcattagagatagtactatttgcgtaatgttgtcatctcttaatttgccagagggtctctcatgcagattttctgagccccattacttgacacttgtcactcccttccctgtgcctcagatgagatattcaagacatgccagccaatttaaacattagcctcagcaaaaacataatggagaagtcaaatctataaaggaaaattaagtataaagtcaattaaaaaataatttgagttgaattaccatttttaattctctatgccactgcccctctctgcccagaattggctgtccttgggagagctatttctgctatgtggctgacgtatttctccccacgttagaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438316 - DNA, 14012 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438317 - DNA, 14075 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438318 - DNA, 14072 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattctgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438319 - DNA, 14072 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438320 - DNA, 4694 bp, Homo sapiens
cttctgataacgaagagatacctgtctgaggcaaacgaaacattggcacacagcacagcctcctcaatccacttgatcccaactcatctctcatttatttcggcttcttttattccaggattaatgtagtgtaacattttcatttcttttcgcttttattctgcttttgtaaaagcagtattttgagatggacattgcctcttcattgtatttctcatcaattcattatttttgtggttatagcttgacaagcaattaactttaaaatggtagattccgtaactttaaattggtagctttcatttgcttaaaattttttggcatatgcagataatgttctcatcagtagtaagaatctcagggttatgcttattccccaatggaggtatgacatataatcttttctgcctttacttatcaattcaccaaggagctgttttctctgcatctaggccatcatactgccaggctggttatgactcagaagatgttatctgaaaaaagtctatagaaaaaaaaaagtttcccctccctcatcaacaaaagcccaccctctaagagacattcaagctgaactatcacaattcttaatcagttacaatttacaaacagataagtttaaaataaacaatttacaaaatttttgaagcataccttaacatcttgttttgcagttaaacaatggaaaagtatttctcctacactaaaaaaaaacttgcttacacacaactgaaaatagaatcttacttgataatacaaaagctaccatcagaagaaatcccttcaggatcattaagccacttcctttgctctgcagtttctatagtagttttaaattattattaaatcacctgaaaaaaattccaaaagagaaccacacactaccatatccaaacaacttttgcatttcccataattgtagttaatgtcagcccagtaggccagaccaacccccagttcaatactttccttccccaaaagctctatactttgaaggaaaacagatacagtatcaaattatgacactttccttgcccaaattaatgcactggtacacccagtggctcatatttaacttcccccagcttcccaattcaaactggggggaaaaaaactaaatcattgggagttacttgccaacttggaagttgatatttctttactttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438321 - DNA, 12623 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagtatatcacatcaacgagtaggcggatcgtagaatcagatcaagtatggagagagcagtcgtgtactctctgaagacacgtgccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggccaatctgtccagacgtgatcagaggcaagcattccaggatcaggataggttgatggttggagagtatcagattcattgaagtcagctctgatgatcatcttg

SEQ ID NO: 438322 - DNA, 12000 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagttctctacactcaccccctcatcctccaccactcctcgatcccacctcctcctccaccgctcagcctctcgcacctctcattacacgcttttctccccccacaatctccttccctccgtctcccctcgcactccgccatcacccctcccctcctcttcccctcctcccccttactacccttcctctcctcctccacctctgtccttgttaagctcaccccacc

SEQ ID NO: 438323 - DNA, 8817 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatcccc

SEQ ID NO: 438324 - DNA, 578 bp, Homo sapiens
aaaacaggtctcaagctattttattgaaatattatttaaaaaataaaacccaatgcaaattgatatgtacatcatctcaataggcctttggtttcaaaaaattgattttatcataatataatacatttcaagtacaccttcacttacagtcagactccagaacaccagaattaagccatggcatatatgatacttaaagtccataaagctctgaggcccagcaatattcttaagagccttctgagtccacttgaaaatgacatgatatctatctagtgaaatttcttatatcctgattcactgaaaacggtaaaaacatcagtttgatctttatttatcaaactattcagctcatcaaaatatgctagtccttcctttccagataaagaggaattactctccaatgtatgggaggttgtaattaacaaaaccgactttaaaaagacttacttttatttgctctcccttgttgggtctacagattggagaggtcatcaggaagggctcaaagaatgacttttttcttcactacatcttcatggagaatgcctttgaactccccactggagctggattac

SEQ ID NO: 438325 - DNA, 568 bp, Homo sapiens
ccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacactgaatgtggctcatttgtattgaaagacagtgaaacgagggcattgataaaatgttctggcacagcaaaacctctagaacacatagtgtgatttaagtaacagaataaaaatggaaacgg

SEQ ID NO: 438326 - DNA, 14126 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438327 - DNA, 14066 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438328 - DNA, 14023 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438329 - DNA, 14072 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacac

SEQ ID NO: 438330 - DNA, 14155 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataaaaccatacagtgagccagccttgcagtaggcagtagactataagcagaagcacatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacacaacaaacaacaaaacaaaaaaaaaaaccc

SEQ ID NO: 438331 - DNA, 14101 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcagtcctctccagataaaaaactcaccatattcaaaactgagttgagggtccgggaatctgatgaggaaactcagatcaaagttaattgggaagaagaggcagcttctggcttgctaacctctctgaaagacaacgtgcccaaggccacaggggtcctttatgattatgtcaacaagtaccactgggaacacacagggctcaccctgagagaagtgtcttcaaagctgagaagaaatctgcagaacaatgctgagtgggtttatcaaggggccattaggcaaattgatgatatcgacgtgaggttccagaaagcagccagtggcaccactgggacctaccaagagtggaaggacaaggcccagaatctgtaccaggaactgttgactcaggaaggccaagccagtttccagggactcaaggataacgtgtttgatggcttggtacgagttactcaagaattccatatgaaagtcaagcatctgattgactcactcattgattttctgaacttccccagattccagtttccggggaaacctgggatatacactagggaggaactttgcactatgttcataagggaggtagggacggtactgtcccaggtatattcgaaagtccataatggttcagaaatactgttttcctatttccaagacctagtgattacacttcctttcgagttaaggaaacataaactaatagatgtaatctcgatgtatagggaactgttgaaagatttatcaaaagaagcccaagaggtatttaaagccattcagtctctcaagaccacagaggtgctacgtaatcttcaggaccttttacaattcattttccaactaatagaagataacattaaacagctgaaagagatgaaatttacttatcttattaattatatccaagatgagatcaacacaatcttcagtgattatatcccatatgtttttaaattgttgaaagaaaacctatgccttaatcttcataagttcaatgaatttattcaaaacgagcttcaggaagcttctcaagagttacagcagatccatcaatacattatggcccttcgtgaagaatattttgatccaagtatagttggctggacagtgaaatattatgaacttgaagaaaagatagtcagtctgatcaagaacctgttagttgctcttaaggacttccattctgaatatattgtcagtgcctctaactttacttcccaactctcaagtcaagttgagcaatttctgcacagaaatattcaggaatatcttagcatccttaccgatccagatggaaaagggaaagagaagattgcagagctttctgccactgctcaggaaataattaaaagccaggccattgcgacgaagaaaataatttctgattaccaccagcagtttagatataaactgcaagatttttcagaccaactctctgattactatgaaaaatttattgctgaatccaaaagattgattgacctgtccattcaaaactaccacacatttctgatatacatcacggagttactgaaaaagctgcaatcaaccacagtcatgaacccctacatgaagcttgctccaggagaacttactatcatcctctaattttttaaaagaaatcttcatttattcttcttttccaattgaactttcacatagcacagaaaaaattcaaactgcctatattgataatatgaactggacctgcaccaaagctggcaccagggctcggaaggtctctgaactcagaaggatggcattttttgcaagttaaagaaaatcaggatctgagttattttgctaaacttgggggaggaggaacaaataaatggagtctttattgtgtatcataacacaacaaacaacaaaacaaaaaaaaaaaccc

SEQ ID NO: 438332 - DNA, 12346 bp, Homo sapiens
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagccatatttttattcctgccatgggcaatattacctatgatttctcctttaaatcaagtgtcatcacactgaataccaatgctgaactttttaaccagtcagatattgttgctcatctcctttcttcatcttcatctgtcattgatgcactgcagtacaaattagagggcaccacaagattgacaagaaaaaggggattgaagttagccacagctctgtctctgagcaacaaatttgtggagggtagtcataacagtactgtgagcttaaccacgaaaaatatggaagtgtcagtggcaaaaaccacaaaagccgaaattccaattttgagaatgaatttcaagcaagaacttaatggaaataccaagtcaaaacctactgtctcttcctccatggaatttaagtatgatttcaattcttcaatgctgtactctaccgctaaaggagcagttgaccacaagcttagcttggaaagcctcacctcttacttttccattgagtcatctaccaaaggagatgtcaagggttcggttctttctcgggaatattcaggaactattgctagtgaggccaacacttacttgaattccaagagcacacggtcttcagtgaagctgcagggcacttccaaaattgatgatatctggaaccttgaagtaaaagaaaattttgctggagaagccacactccaacgcatatattccctctgggagcacagtacgaaaaaccacttacagctagagggcctctttttcaccaacggagaacatacaagcaaagccaccctggaactctctccatggcaaatgtcagctcttgttcaggtccatgcaagtcagcccagttccttccatgatttccctgaccttggccaggaagtggccctgaatgctaacactaagaaccagaagatcagatggaaaaatgaagtccggattcattctgggtctttccagagccaggtcgagctttccaatgaccaagaaaaggcacaccttgacattgcaggatccttagaaggacacctaaggttcctcaaaaatatcatcctaccagtctatgacaagagcttatgggatttcctaaagctggatgtaaccaccagcattggtaggagacagcatcttcgtgtttcaactgcctttgtgtacaccaaaaaccccaatggctattcattctccatccctgtaaaagttttggctgataaattcattattcctgggctgaaactaaatgatctaaattcagttcttgtcatgcctacgttccatgtcccatttacagatcttcaggttccatcgtgcaaacttgacttcagagaaatacaaatctataagaagctgagaacttcatcatttgccctcaacctaccaacactccccgaggtaaaattccctgaagttgatgtgttaacaaaatattctcaaccagaagactccttgattcccttttttgagataaccgtgcctgaatctcagttaactgtgtcccagttcacgcttccaaaaagtgtttcagatggcattgctgctttggatctaaatgcagtagccaacaagatcgcagactttgagttgcccaccatcatcgtgcctgagcagaccattgagattccctccattaagttctctgtacctgctggaattgtcattccttcctttcaagcactgactgcacgctttgaggtagactctcccgtgtataatgccacttggagtgccagtttgaaaaacaaagcagattatgttgaaacagtcctggattccacatgcagctcaaccgtacagttcctagaatatgaactaaatgttttgggaacacacaaaatcgaagatggtacgttagcctctaagactaaaggaacatttgcacaccgtgacttcagtgcagaatatgaagaagatggcaaatatgaaggacttcaggaatgggaaggaaaagcgcacctcaatatcaaaagcccagcgttcaccgatctccatctgcgctaccagaaagacaagaaaggcatctccacctcagcagcctccccagccgtaggcaccgtgggcatggatatggatgaagatgacgacttttctaaatggaacttctactacagccctcaggctcccaagtacaaatagagtgacccgtaaaatccaggattttttgttttttgctacaatcttgaccccctttggctacattcctttttttctgtgaaatatgtgaataataattaaacacttagacttg

SEQ ID NO: 438333 - DNA, 10151 bp, Homo sapiens
  misc_feature (10134)..(10134): n is a, c, g, or t
cattcccaccgggacctgcggggctgagtgcccttctcggttgctgccgctgaggagcccgcccagccagccagggccgcgaggccgaggccaggccgcagcccaggagccgccccaccgcagctggcgatggacccgccgaggcccgcgctgctggcgctgctggcgctgcctgcgctgctgctgctgctgctggcgggcgccagggccgaagaggaaatgctggaaaatgtcagcctggtctgtccaaaagatgcgacccgattcaagcacctccggaagtacacatacaactatgaggctgagagttccagtggagtccctgggactgctgattcaagaagtgccaccaggatcaactgcaaggttgagctggaggttccccagctctgcagcttcatcctgaagaccagccagtgcaccctgaaagaggtgtatggcttcaaccctgagggcaaagccttgctgaagaaaaccaagaactctgaggagtttgctgcagccatgtccaggtatgagctcaagctggccattccagaagggaagcaggttttcctttacccggagaaagatgaacctacttacatcctgaacatcaagaggggcatcatttctgccctcctggttcccccagagacagaagaagccaagcaagtgttgtttctggataccgtgtatggaaactgctccactcactttaccgtcaagacgaggaagggcaatgtggcaacagaaatatccactgaaagagacctggggcagtgtgatcgcttcaagcccatccgcacaggcatcagcccacttgctctcatcaaaggcatgacccgccccttgtcaactctgatcagcagcagccagtcctgtcagtacacactggacgctaagaggaagcatgtggcagaagccatctgcaaggagcaacacctcttcctgcctttctcctacaagaataagtatgggatggtagcacaagtgacacagactttgaaacttgaagacacaccaaagatcaacagccgcttctttggtgaaggtactaagaagatgggcctcgcatttgagagcaccaaatccacatcacctccaaagcaggccgaagctgttttgaagactctccaggaactgaaaaaactaaccatctctgagcaaaatatccagagagctaatctcttcaataagctggttactgagctgagaggcctcagtgatgaagcagtcacatctctcttgccacagctgattgaggtgtccagccccatcactttacaagccttggttcagtgtggacagcctcagtgctccactcacatcctccagtggctgaaacgtgtgcatgccaacccccttctgatagatgtggtcacctacctggtggccctgatccccgagccctcagcacagcagctgcgagagatcttcaacatggcgagggatcagcgcagccgagccaccttgtatgcgctgagccacgcggtcaacaactatcataagacaaaccctacagggacccaggagctgctggacattgctaattacctgatggaacagattcaagatgactgcactggggatgaagattacacctatttgattctgcgggtcattggaaatatgggccaaaccatggagcagttaactccagaactcaagtcttcaatcctgaaatgtgtccaaagtacaaagccatcactgatgatccagaaagctgccatccaggctctgcggaaaatggagcctaaagacaaggaccaggaggttcttcttcagactttccttgatgatgcttctccgggagataagcgactggctgcctatcttatgttgatgaggagtccttcacaggcagatattaacaaaattgtccaaattctaccatgggaacagaatgagcaagtgaagaactttgtggcttcccatattgccaatatcttgaactcagaagaattggatatccaagatctgaaaaagttagtgaaagaagctctgaaagaatctcaacttccaactgtcatggacttcagaaaattctctcggaactatcaactctacaaatctgtttctcttccatcacttgacccagcctcagccaaaatagaagggaatcttatatttgatccaaataactaccttcctaaagaaagcatgctgaaaactaccctcactgcctttggatttgcttcagctgacctcatcgagattggcttggaaggaaaaggctttgagccaacattggaagctctttttgggaagcaaggatttttcccagacagtgtcaacaaagctttgtactgggttaatggtcaagttcctgatggtgtctctaaggtcttagtggaccactttggctataccaaagatgataaacatgagcaggatatggtaaatggaataatgctcagtgttgagaagctgattaaagatttgaaatccaaagaagtcccggaagccagagcctacctccgcatcttgggagaggagcttggttttgccagtctccatgacctccagctcctgggaaagctgcttctgatgggtgcccgcactctgcaggggatcccccagatgattggagaggtcatcaggaagggctcaaagaatgacttttttcttcactacatcttcatggagaatgcctttgaactccccactggagctggattacagttgcaaatatcttcatctggagtcattgctcccggagccaaggctggagtaaaactggaagtagccaacatgcaggctgaactggtggcaaaaccctccgtgtctgtggagtttgtgacaaatatgggcatcatcattccggacttcgctaggagtggggtccagatgaacaccaacttcttccacgagtcgggtctggaggctcatgttgccctaaaagctgggaagctgaagtttatcattccttccccaaagagaccagtcaagctgctcagtggaggcaacacattacatttggtctctaccaccaaaacggaggtgatcccacctctcattgagaacaggcagtcctggtcagtttgcaagcaagtctttcctggcctgaattactgcacctcaggcgcttactccaacgccagctccacagactccgcctcctactatccgctgaccggggacaccagattagagctggaactgaggcctacaggagagattgagcagtattctgtcagcgcaacctatgagctccagagagaggacagagccttggtggataccctgaagtttgtaactcaagcagaaggtgcgaagcagactgaggctaccatgacattcaaatataatcggcagagtatgaccttgtccagtgaagtccaaattccggattttgatgttgacctcggaacaatcctcagagttaatgatgaatctactgagggcaaaacgtcttacagactcaccctggacattcagaacaagaaaattactgaggtcgccctcatgggccacctaagttgtgacacaaaggaagaaagaaaaatcaagggtgttatttccataccccgtttgcaagcagaagccagaagtgagatcctcgcccactggtcgcctgccaaactgcttctccaaatggactcatctgctacagcttatggctccacagtttccaagagggtggcatggcattatgatgaagagaagattgaatttgaatggaacacaggcaccaatgtagataccaaaaaaatgacttccaatttccctgtggatctctccgattatcctaagagcttgcatatgtatgctaatagactcctggatcacagagtccctcaaacagacatgactttccggcacgtgggttccaaattaatagttgcaatgagctcatggcttcagaaggcatctgggagtcttccttatacccagactttgcaagaccacctcaatagcctgaaggagttcaacctccagaacatgggattgccagacttccacatcccagaaaacctcttcttaaaaagcgatggccgggtcaaatataccttgaacaagaacagtttgaaaattgagattcctttgccttttggtggcaaatcctccagagatctaaagatgttagagactgttaggacaccagccctccacttcaagtctgtgggattccatctgccatctcgagagttccaagtccctacttttaccattcccaagttgtatcaactgcaagtgcctctcctgggtgttctagacctctccacgaatgtctacagcaacttgtacaactggtccgcctcctacagtggtggcaacaccagcacagaccatttcagccttcgggctcgttaccacatgaaggctgactctgtggttgacctgctttcctacaatgtgcaaggatctggagaaacaacatatgaccacaagaatacgttcacactatcatgtgatgggtctctacgccacaaatttctagattcgaatatcaaattcagtcatgtagaaaaacttggaaacaacccagtctcaaaaggtttactaatattcgatgcatctagttcctggggaccacagatgtctgcttcagttcatttggactccaaaaagaaacagcatttgtttgtcaaagaagtcaagattgatgggcagttcagagtctcttcgttctatgctaaaggcacatatggcctgtcttgtcagagggatcctaacactggccggctcaatggagagtccaacctgaggtttaactcctcctacctccaaggcaccaaccagataacaggaagatatgaagatggaaccctctccctcacctccacctctgatctgcaaagtggcatcattaaaaatactgcttccctaaagtatgagaactacgagctgactttaaaatctgacaccaatgggaagtataagaactttgccacttctaacaagatggatatgaccttctctaagcaaaatgcactgctgcgttctgaatatcaggctgattacgagtcattgaggttcttcagcctgctttctggatcactaaattcccatggtcttgagttaaatgctgacatcttaggcactgacaaaattaatagtggtgctcacaaggcgacactaaggattggccaagatggaatatctaccagtgcaacgaccaacttgaagtgtagtctcctggtgctggagaatgagctgaatgcagagcttggcctctctggggcatctatgaaattaacaacaaatggccgcttcagggaacacaatgcaaaattcagtctggatgggaaagccgccctcacagagctatcactgggaagtgcttatcaggccatgattctgggtgtcgacagcaaaaacattttcaacttcaaggtcagtcaagaaggacttaagctctcaaatgacatgatgggctcatatgctgaaatgaaatttgaccacacaaacagtctgaacattgcaggcttatcactggacttctcttcaaaacttgacaacatttacagctctgacaagttttataagcaaactgttaatttacagctacagccctattctctggtaactactttaaacagtgacctgaaatacaatgctctggatctcaccaacaatgggaaactacggctagaacccctgaagctgcatgtggctggtaacctaaaaggagcctaccaaaataatgaaataaaacacatctatgccatctcttctgctgccttatcagcaagctataaagcagacactgttgctaaggttcagggtgtggagtttagccatcggctcaacacagacatcgctgggctggcttcagccattgacatgagcacaaactataattcagactcactgcatttcagcaatgtcttccgttctgtaatggccccgtttaccatgaccatcgatgcacatacaaatggcaatgggaaactcgctctctggggagaacatactgggcagctgtatagcaaattcctgttgaaagcagaacctctggcatttactttctctcatgattacaaaggctccacaagtcatcatctcgtgtctaggaaaagcatcagtgcagctcttgaacacaaagtcagtgccctgcttactccagctgagcagacaggcacctggaaactcaagacccaatttaacaacaatgaatacagccaggacttggatgcttacaacactaaagataaaattggcgtggagcttactggacgaactctggctgacctaactctactagactccccaattaaagtgccacttttactcagtgagcccatcaatatcattgatgctttagagatgagagatgccgttgagaagccccaagaatttacaattgttgcttttgtaaagtatgataaaaaccaagatgttcactccattaacctcccattttttgagaccttgcaagaatattttgagaggaatcgacaaaccattatagttgtactggaaaacgtacagagaaacctgaagcacatcaatattgatcaatttgtaagaaaatacagagcagccctgggaaaactcccacagcaagctaatgattatctgaattcattcaattgggagagacaagtttcacatgccaaggagaaactgactgctctcacaaaaaagtatagaattacagaaaatgatatacaaattgcattagatgatgccaaaatcaactttaatgaaaaactatctcaactgcagacatatatgatacaatttgatcagtatattaaagatagttatgatttacatgatttgaaaatagctattgctaatattattgatgaaatcattgaaaaattaaaaagtcttgatgagcactatcatatccgtgtaaatttagtaaaaacaatccatgatctacatttgtttattgaaaatattgattttaacaaaagtggaagtagtactgcatcctggattcaaaatgtggatactaagtaccaaatcagaatccagatacaagaaaaactgcagcagcttaagagacacatacagaatatagacatccagcacctagctggaaagttaaaacaacacattgaggctattgatgttagagtgcttttagatcaattgggaactacaatttcatttgaaagaataaatgatgttcttgagcatgtcaaacactttgttataaatcttattggggattttgaagtagctgagaaaatcaatgccttcagagccaaagtccatgagttaatcgagaggtatgaagtagaccaacaaatccaggttttaatggataaattagtagagttggcccaccaatacaagttgaaggagactattcagaagctaagcaatgtcctacaacaagttaagataaaagattactttgagaaattggttggatttattgatgatgctgtcaagaagcttaatgaattatcttttaaaacattcattgaagatgttaacaaattccttgacatgttgataaagaaattaaagtcatttgattaccaccagtttgtagatgaaaccaatgacaaaatccgtgaggtgactcagagactcaatggtgaaattcaggctctggaactaccacaaaaagctgaagcattaaaactgtttttagaggaaaccaaggccacagttgcagtgtatctggaaagcctacaggacaccaaaataaccttaatcatcaattggttacaggaggctttaagttcagcatctttggctcacatgaaggccaaattccgagagactctagaagatacacgagaccgaatgtatcaaatggacattcagcaggaacttcaacgatacctgtctctggtaggccaggtttatagcacacttgtcacctacatttctgattggtggactcttgctgctaagaaccttactgactttgcagagcaatattctatccaagattgggctaaacgtatgaaagcattggtagagcaagggttcactgttcctgaaatcaagaccatccttgggaccatgcctgcctttgaagtcagtcttcaggctcttcagaaagctaccttccagacacctgattttatagtccccctaacagatttgaggattccatcagttcagataaacttcaaagacttaaaaaatataaaaatcccatccaggttttccacaccagaatttaccatccttaacaccttccacattccttcctttacaattgactttgtagaaatgaaagtaaagatcatcagaaccattgaccagatgctgaacagtgagctgcagtggcccgttccagatatatatctcagggatctgaaggtggaggacattcctctagcgagaatcaccctgccagacttccgtttaccagaaatcgcaattccagaattcataatcccaactctcaaccttaatgattttcaagttcctgaccttcacataccagaattccagcttccccacatctcacacacaattgaagtacctacttttggcaagctatacagtattctgaaaatccaatctcctcttttcacattagatgcaaatgctgacatagggaatggaaccacctcagcaaacgaagcaggtatcgcagcttccatcactgccaaaggagagtccaaattagaagttctcaattttgattttcaagcaaatgcacaactctcaaaccctaagattaatccgctggctctgaaggagtcagtgaagttctccagcaagtacctgagaacggagcatgggagtgaaatgctgttttttggaaatgctattgagggaaaatcaaacacagtggcaagtttacacacagaaaaaaatacactggagcttagtaatggagtgattgtcaagataaacaatcagcttaccctggatagcaacactaaatacttccacaaattgaacatccccaaactggacttctctagtcaggctgacctgcgcaacgagatcaagacactgttgaaagctggccacatagcatggacttcttctggaaaagggtcatggaaatgggcctgccccagattctcagatgagggaacacatgaatcacaaattagtttcaccatagaaggacccctcacttcctttggactgtccaataagatcaatagcaaacacctaagagtaaaccaaaacttggtttatgaatctggctccctcaacttttctaaacttgaaattcaatcacaagtcgattcccagcatgtgggccacagtgttctaactgctaaaggcatggcactgtttggagaagggaaggcagagtttactgggaggcatgatgctcatttaaatggaaaggttattggaactttgaaaaattctcttttcttttcagcccagccatttgagatcacggcatccacaaacaatgaagggaatttgaaagttcgttttccattaaggttaacagggaagatagacttcctgaataactatgcactgtttctgagtcccagtgcccagcaagcaagttggcaagtaagtgctaggttcaatcagtataagtacaaccaaaatttctctgctggaaacaacgagaacattatggaggcccatgtaggaataaatggagaagcaaatctggatttcttaaacattcctttaacaattcctgaaatgcgtctaccttacacaataatcacaactcctccactgaaagatttctctctatgggaaaaaacaggcttgaaggaattcttgaaaacgacaaagcaatcatttgatttaagtgtaaaagctcagtataagaaaaacaaacacaggcattccatcacaaatcctttggctgtgctttgtgagtttatcagtcagagcatcaaatcctttgacaggcattttgaaaaaaacagaaacaatgcattagattttgtcaccaaatcctataatgaaacaaaaattaagtttgataagtacaaagctgaaaaatctcacgacgagctccccaggacctttcaaattcctggatacactgttccagttgtcaatgttgaagtgtctccattcaccatagagatgtcggcattcggctatgtgttcccaaaagcagtcagcatgcctagtttctccatcctaggttctgacgtccgtgtgccttcatacacattaatcctgccatcattagagctgccagtccttcatgtccctagaaatctcaagctttctcttccacatttcaaggaattgtgtaccataagcctgagatttggaaagaataaaacnccgaattgcagaagagc

SEQ ID NO: 438334 - DNA, 776 bp, Homo sapiens
taatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtttagttttttgtttttactctaaagatagaattggggagtaaacttcagtttttgtttagagtggatctgaatatttaaaatcctataataatttttgtgaatcttcattctttgagtatgggattgtaaaagacaaactatatcctacagtagtatcatcatcagtatcaaaggtctcctttttttacttggaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaa

SEQ ID NO: 438335 - DNA, 347 bp, Homo sapiens
ggaggggccagcggccgattagttcaaaagtaattcacaaacattataaaaatactattcaaacagtaccaaagagtagattagcaaaagtaagtttttttccctagcctgtctcatttttccatcattacacagactacttggaatgtcttagatgtccttgtattgtaattttctgtgtaggtagaaataaatgtagctttcttattttacacaaataggaacttactgtatatactgttctgcactttgcttttattaaagatcttttgataaagaactatattgataagcagtaaagatgtcatgctcctggcccaataaaatattgttagcattgtcataaa

SEQ ID NO: 438336 - DNA, 3079 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438337 - DNA, 3108 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagca

SEQ ID NO: 438338 - DNA, 868 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtg

SEQ ID NO: 438339 - DNA, 444 bp, Homo sapiens
gggtagaaatcttgctttcatttttagatcagctgaagagaaaaacattcactttaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagca

SEQ ID NO: 438340 - DNA, 1029 bp, Homo sapiens
gcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatctta

SEQ ID NO: 438341 - DNA, 989 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggtttctcttcttttggccactgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcaccatacatttattacataagctggaaatctagatgtccttcttagcctaaatagccctttcttgatatctcccataccccaaaaattcttttccat

SEQ ID NO: 438342 - DNA, 503 bp, Homo sapiens
aaggccttctgacaaggatctcgtttttttcttccctcacctaaggtatgcaccgtacctccttcaccgcccccaccaacccccgtttgattgattgtttattctgtctcctttgcaggtttctcttcttttggccactgatgttgggattcttcgcagccatccctggccctctttctttcctctattttcatggtgttttcttctaagcccaaagtttaagtaactttgccatgataacccaagtttatgtctccagctcagacttctttgacccatatatccagctgcctattcaacattgccatgcaaatgtcaaactcattatattcaaactgaatttgtgattttacccctgggacctgaccctcttccaatgatctctttctcatgattagtaccactcaccatacatttattacataagctggaaatctagatgtccttcttagcctaaatagccctttcttgatatctcccataccccaaaaattcttttccat

SEQ ID NO: 438343 - DNA, 3154 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438344 - DNA, 7060 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438345 - DNA, 7006 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438346 - DNA, 5424 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438347 - DNA, 6772 bp, Homo sapiens
gcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438348 - DNA, 6855 bp, Homo sapiens
  misc_feature (11)..(11): n is a, c, g, or t
  misc_feature (16)..(16): n is a, c, g, or t
  misc_feature (31)..(31): n is a, c, g, or t
  misc_feature (51)..(51): n is a, c, g, or t
gtgaccaattnatatngtggtaacacccatnattgaaaaccacgcgtttgngttttataaaacacagcagctgtcggtcgattccggatgcctgtggcgtcagatgtcgacagaattcgagtcagtggacgggactggatggccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438349 - DNA, 6811 bp, Homo sapiens
cgctaatggaagataccttgtgattgctggaaaataatcgcactcctttcacaccacaatctaatacgagcaccgtcgacgggcgactggatttgccctgtaccacaaagatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438350 - DNA, 7419 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctgaaaaaaaaaaaaaaaaaaaaaacaaacaaaacaaaaaacatgtgtgtggggcgcgcccttgggccctctagaaaaaagtttttctaaaacccattctcgttttggggcgcggcgcggggccccccatagttgggtatacacttcgacactgtcggtccataacgcgtgtcccctaagagaacaacccggggctcataaagatcgtcgcttgtggttttcctacccacattaaaaaaacgcccggggggaaagccaggacaggtgtctgaaacaactcccagaaggaactcaagggggccataaccgggactctacaataggggttctcaaagcgaaccttgaatatcaatttccgcccgt

SEQ ID NO: 438351 - DNA, 6805 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaatcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438352 - DNA, 7006 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagtctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438353 - DNA, 6193 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccaggttgatattgacttattcatactagctgcatgaatataaccctatagcaaattgtacaatcatcttgtgtgacctagatttccaaaacttatttatgagtatattttctcatacacagaagccttgctgtatcttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438354 - DNA, 2791 bp, Homo sapiens
gcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438355 - DNA, 2866 bp, Homo sapiens
gcctgaaagcttaacaaagtggggctataactagtaattttttggtaaaaatatagtgatctttttctacagggtattattataagggacaaattatagttgtaaattagattaatgaattttgtgagttttaaaatttgtacgaaccatgtctcccttgtgtcatattttccaataatataattacctaacaatgacagaattatacattttccctttaattctctaagcattgagtaaacagaaaaatatagggatgaaatacacacatgccaacattcaaaactttgtactaactagaaacaaaaatagaaggggatttataaaggaaaatgatggagacattttagagaaattaagtataaatcgcaacattctgttttcttggatgtattctgggtagcttctagttacttgtaaacaaagtattcattgtttttgtaataaagtgataatgttttgttttatagttgagtggctttagggtaatttaatcacctggaaagtgatatttttttaattaccttttgttactaaatcttatctaatttaaaatactatgttttgaaagtatatatcttgtatagttatctttttatatgaaaatgaactctaatacatatctttctttcagtgttcatatcacaaagctcaattaaatggtcctggaaaaaaaaaatcgttccatgttgttccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438356 - DNA, 2305 bp, Homo sapiens
gccagaaggtttaaaaataatattttttataacaaaaacccctacggggttttttttacataatagacttcttacactttctacaccgtgtcacagggattggtttagtcacacttccattaccaagtttatatgcttttgttgtacattttctgtaattttacacatttttgcaaggcttttctttgatatcttaaataattgagaggtggctatattttgaaatgagattcttttgaaattgtagagaattttttattgtatttatatgataactgggctcatatccaaagtctaaacatcagataattttatgtgtgtaagttcctatctcaatttttaatttttttgctagcatcatggtactgaattttgtatactttcacagtcttaagaatgaatgctgagatttagctctagcttactagaatgcctactctctccattatgtcttacagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438357 - DNA, 2212 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438358 - DNA, 3737 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatctta

SEQ ID NO: 438359 - DNA, 3997 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagctttctcaaagaggttttgatcagttgtattttttcctcattactgatagaataaatgttcttcgctggaaagcattctttgattgtgaaaggagtttttattctgaaattaaagctttgtaagaccattgtaggagaaacttttcttttttctttttaaatatttattttagagacaggtctcactatgttggccaggctggtcttaaactcctaaccttaagtgatcctcctccagcctcccaaagtgcggggattataggcatgaaccaccatgcccagcttttttctgtttcttaagtccaaggaggccatttcttcataagctgaaaaaactttgaagttatctgtccagccatccttcaggagagggtagaacatgtaaataaaccttattgtcctcaattttctacttaaagt

SEQ ID NO: 438360 - DNA, 1330 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctgtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438361 - DNA, 1317 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatctta

SEQ ID NO: 438362 - DNA, 1741 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtaaacgggtacaggtcaagggtaacaccagtcaaaatgtcagtatctaacttttttatttataaattttgtttttcttgacgaaataaactttcctttttattttaaaaatttaattcaaatcaacttttaaaataatttttcagcttagtaccatacagttgttgtccagtatttttagaaaagtaaagtcttagcatgaaacttccttaacctattttagcctcatgcttttgactaaaatagacttaaaaactgaattaaatttttatatacacttatatttaattaatctaaagagatagcttacatatagaaattaagtaaaggggagatctgtattttcattcaagatgttaaaggctagcacagaaattttctaggcattaaatcattgcttattacataatgtttttaatagtttgctttgatatcagtattgtgaataacggagcaaattcagccatattagttctgttgacttcatgctcataattttgagaagtccaggcgtaaactaaaactcttttggtgtacttgaatattctttgtttgttgatgtaaaatatgtaatctctgattttatagttaacaataaaaataaaattttaggtgagtgaaagcagtgatttaaatttaacagtgtcctcttgaaaaaccttaatcacagttaagtgatggcatgggcaatgaattttaatcatatttaggaataaaatactagatattagtgtataacaattagatatatgtta

SEQ ID NO: 438363 - DNA, 1392 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatctta

SEQ ID NO: 438364 - DNA, 1293 bp, Homo sapiens
gtcttgcggtgttgcacaggctggtctcgaattcctggactcaagcagtcttcctgtcttggcctcccaaagtgctaggattataggtgtgagccactacgcctggcctgtatctcccttcacatgtcagacagccaattttactgtatttaaattcttcctaaatcctctattcaccaaacctgtatctcatgttgtatttcatattgataaacatcattatcagtacttgataatcctcttagatttcctttttgtgaacactaccactgctttgatttgtgggctaggatattgtagtttcttcctaaatggtcatttggcatttagtaggatttcagtaatatttgctaaatgaatttttttcaccaagcattgatcacttcatcactgatgctagaatgctcttaactaacgagcatttcatttcatgttatttctttgtttaaaccctttcagtgccttttcatggctttcagaattcaactacaatccttatgcatatagtaaaaagttcaggggttttttccaggactcacactacccccacctcccaattctaacctacttaggtgcacagaacctatacactagctacgttaactatgctgaactactaataggctttcatcttagtacaagtttcttatacctgggataccctacacataccccactaccatttcttttttcatttagctttcatgactcaattcagaacactaggatgccatccctgatgcctcttccctttcaatgggaattgggtgaaactcctaaaagtttctccttccccagtatccctctcccttagcatagtgtttgtcattatagcaagcactcaaatgtttgatgagggtcaatatctgttacctttctcaaagaggttttgatcagttgtattttttcctcattactgatagaataaatgttcttcgctggaaagcattctttgattgtgaaaggagtttttattctgaaattaaagctttgtaagaccattgtaggagaaacttttcttttttctttttaaatatttattttagagacaggtctcactatgttggccaggctggtcttaaactcctaaccttaagtgatcctcctccagcctcccaaagtgcggggattataggcatgaaccaccatgcccagcttttttctgtttcttaagtccaaggaggccatttcttcataagctgaaaaaactttgaagttatctgtccagccatccttcaggagagggtagaacatgtaaataaaccttattgtcctcaattttctacttaaagt

SEQ ID NO: 438365 - DNA, 6520 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438366 - DNA, 4557 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctga

SEQ ID NO: 438367 - DNA, 4758 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagttgggtttctgtagaaataagaatgggtgttcttaagtgtgtttaatagataaagtaaactttcctagtcaagggttagatttttattatctcttgtgttccgactttctacttttcaactttgaacttcaaaaaaacattactttgcttatcctttgtactttgatcaggttgtttagaattgtagatcaaaccattctttgatcattttattgtttaaatttttagttccatttataatttttatagccaactctcggttatttctgtcttttgagattgcaattcagaagctgtatgtcgaagtaatttatgagttgacttttatacttaggcttctttaaatactaatagtcaagaattctagagcatctaataaaaaattaactttcagatcattgggaatctgtcctcatttaaatatgtgtaaatgcatttccacagcaaattgcttcatgccctttgtctataaggaaattattccttgtagctaatacatttttcattttgcagtccaaatcttttttgagaaaggcctatattaggttactttatctgtactgacacttttaatattggaagaatgcaactgtcatctgtcagccttttctgcaacaggctaattactcagtttcattaattttctctttgttcccaattatatagtcattttaatggctttatttgtagtctttgcaaatttttcatattttattagcttgtgaaaataaagattatgtaaagtctattaattgctgggttcagtggtaggattatctcatgattcctacttgtacagaatgattagttttgcttcttcacattttggagtttagatgttaagatttcacacagtcttgtttctctgcatttgtttctttgtaaaaaaaattactctgtttttgagtggaattcattctgttgctttcttaccacttctgcaaatttttatcttagccacatataatccccctagtttgttgtcatctaaacttaatgaacatgttctctattccataagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatctta

SEQ ID NO: 438368 - DNA, 3718 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaatttagcattaaagggctgccacagtataatcatgttaaggagaaaagaatgttgtgcacacttgcattataagccaataagaaatagataacaaggccaggctcagtggctcacgcctgtaatcccaataccttgggaggccaaggtgggcgggctgcttgagcccaggagttcaagaccagcctgggcaatatagtgagacctcgtctactaaaaataaaaattaaaacaaccagccaggcatggtggtgtgttcttataggctgaggtggaaggatcactggagccctggagattaagggtgcagtgagccatgcttatgctactgcaccacagcctggggaacagagcaagatcctgtctcaaaaaaaaaaaaaaaaaatagaagtagagagcaaattattttttattgttaccattatttagtaacaatatttaagcgctttataggtaaaaatccttaagttctggtattccctttgggaaccattataattaaggtttacagaacacccatcatattcttcccaaacattttttcattgcttgtaactttccaaagaattctccttttgggctttctggttttattttaagcccaaaggtgaattttttgggaagtttgagctaaattccttcaaccaaaatatacaagtgaagaaaaaaaatttgtatttaaacatttgcacatttacttctacctgaagcatgtgaatgtcaacacttcatatttcataagtagtgggttttcataaaaatagtattgtaaatataaatcatcttaaagttagtttttatttcttcttgaatatttagcagttaagtacagttactagtcttttgttgctgtgccatatacctggtttttccataacagtttaatgagttgaataattccacatggaattatgtttattttcctcaggaagtggtatataagatacatattttaatcctcaaatggaaggatgtagttcctaaacgtaaagtcctgttaatgcagttatctgctgattttataatactataatatttgtgtatactttgaaaagccttaaaaaaagtttaaattctattttgatatagtaagcagggttttaattacacatgatagaattttaaagagacaaaattaaaatgtttaagtagaatgttttcatggttgatccagaagtcttctgttgaataagcagtaagtattcttccttataaaattttcatagttgttataaatcctgtttatttttggagctatctgataactaaataatcttccttatttcttcttttaatgaaatgtttgatttgtttctcaatcaatgaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagcgttaatattcatctgctgagagcagttatgggacccatgtcaggaatacatgcttcaaataagatgggacttgagaattgctgagagacttcaggaacattctttaacttcatggggcctcagttaccccacctttaagg

SEQ ID NO: 438369 - DNA, 2149 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaaggtgaatgaggtagcatctctctgtaaagcagagagaaaaatatttaaaggctgcagaaggtgttgctgctttttttccccttattttgcttctacttgtcgattttattttagcattagaaaactaatgcacttgcctcagcttaattttctcaccatgaaatgtttccattgccagcagtgtgccaagacattcccatgattgaaatcaggtggctattttgcaatatgcagcgtttattattttggcactaagatgttatgaagtaggaagatgaagccaagtcttatcgccacatctctagtatattaagattatatatggccaggcacagtgattcatgcctataatcccagcactttgggaagctgaggtgggaggatcacttgaggccaggagttcaaggttgtagtgaaccttgatcacagcactgtaatccagcctgggtgacagaggagtgtctcaaaaaaaaaaaaaaaaattaatagtagttcaaataaaattacatatgtaaataaaaagaaaaattttcttcattattaaaaggaagaaaaataaccctgcctcaaaacaggtcctgttttgcacggcagttgtttcaatattttcagaaacaaatttgccatttatatcagataaagttactagagtactgtatatacattttcctttctaattttacacacgctattatttatagagcacaaaacactcaaaactaaatcaggaagtatagtcggttagttgagataggatgtggtcttaagtagtaaacagtgttctaaagtttcaggttgcatgtagtcacatctgtagagggaaacataatttgaaagatgctcttgcaggaaatttttctttgtttagtcaaaatatgctctctttgtttttaagttaatttattatgacctaaaggcatctaaaaaataaataagaaaatgaaattccatatttgtggaaattcatattgaagtctaactgtggctgttttggtaaaagtatttgctgctttgaatcaaattaacatggctggccagtttatatggtggggatgggggccactgcttatagccatg

SEQ ID NO: 438370 - DNA, 698 bp, Homo sapiens
tccgaggcttctagtgccacgaaggcctcctgcctgggttgtccttatggcgcctgtgagtttagttctagaaaagatatttgtattttaacttttccatctaacaaacagtagcacaggcatcttagtctggacaacaacgtacaagctgaattcctggctagttccctcattatcaaaccctgacacagtagtaggcgcgagtcaggcagtgtggggacagccccgagttgccgaaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggtggtggtgtgtaatgaaagagaaaatgtcgaaaatatcaagatataagagctactgagggttgcatatatgaagacacttctcctgaattcag

SEQ ID NO: 438371 - DNA, 1085 bp, Homo sapiens
  misc_feature (1021)..(1021): n is a, c, g, or t
  misc_feature (1046)..(1046): n is a, c, g, or t
gagttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccacgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgntcaaacaagctcgtttggaggctanggctaatagtgaaaaagcacagcttgtccctgctgctgg

SEQ ID NO: 438372 - DNA, 1010 bp, Homo sapiens
gagttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcatgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccacgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctaa

SEQ ID NO: 438373 - DNA, 872 bp, Homo sapiens
agatgaggcaggaagcactcattccatatcaggaagtgatcagttcctcaaaactggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcatgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccacgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctaa

SEQ ID NO: 438374 - DNA, 1025 bp, Homo sapiens
gagttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttagcgcgtgctgtcccacacttcgatcgcggagaaggcaaaggagttaaagatgatatctggagcagcacaactcacaatcgcaaagatgtggaaccaacctaactgcccatcaagcaatgagtggataaagaaaatgtggtatatatacaccatggaatactactcagccacaaaaaggaacgtaaataataccctttgcagcaacttggacggagctggaggcctattatcctaagtaaagtaattcaggaatggataccaaatatcatatgttctcacttatgagtagatgctaagtctatgatgatgcaatagacataagtatgatatagctttccgtctccctct

SEQ ID NO: 438375 - DNA, 1063 bp, Homo sapiens
gagttttcagtcatgttgtttctttaagttggtttagccttcctgtatacatgtgataatgatactgttttaaagaacaggtgtgaaagtctaagagtttaatccagactctgcacaagaagttaatctgccaaaccctaggattctccttctgaaagctcagaatatttcttccccttccctatacacacagggctcgaagggttagagaagaaaggcagacaacagcttctgagctttggactaatcacagcctctgttctcagcaggagccccaacactgagaccagaaaagatggtgctatgctttcctcttcttttactgctgctggttctatggggaccagtgtgtccacttcatgcttggcctaagcgtctcaccaaggctcactggtttgaaattcagcatatacagccaagtcctctccaatgcaacagggcaatgagtggcatcaacaattatacccagcactgtaagcatcaaaatacctttctgcatgactctttccagaatgtggctgctgtctgtgatttgctcagcattgtctgcaaaaatcgtcggcacaactgccaccagagctcaaagcctgtcaacatgactgactgcagactcacttcaggaaagtatccccagtgccgctatagtgctgctgcccagtacaaattcttcattgttgcctgtgacccccctcagaagagcgatcccccctacaagttggttcctgtacacttagatagtattctctaaggcatccactgcatttcctttcatttgacatagcttctgttacaattgcatccacgttttcttttcttttgttgattttcttgttcccgtagaagaaagaagaaaggtgtttggagaattcgagtgcctaggatgccagaccagagttgagacaaaaagaaataagattattttctgctttgtagttctgtacttttcgagagaagggaatagggaagacagcaaagaaagattcagatttctaaccctgcaacttttgccaagctttattgccctgtgttcacagcaataaaaccacttcctgctgcattctaa

SEQ ID NO: 438376 - DNA, 4126 bp, Homo sapiens
gctgggtcaatagtacttgccgcagtactcttaaaactagcgatggaggcttcgacatgggctttagggagtcataagtggagtccggaaagaggtatctgtactataaaagctattgtgtaagctagtcatattaagttgttggctcaggagtttgaagtccttgagagaggattatgatgcgacgtgagtgcgttcgtaatttgagtctgcttggcagatagtaatgaggatgtaagcccgtgggcgattatgagaatgactgcgccggtgaagcttcagggggtttggatgagaatggctgttactacgagggctatgtggctgattgaagagtatgcaatgagcgattttaggtctgtttgtcgtaggcagatggagcttgttataattatgcctcatagggatagtacaaggaaggggtaggctatgtgttttgtcagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438377 - DNA, 3233 bp, Homo sapiens
tgcggagtacgcatgcagactgctaacagggataccctagcggtggaacattactgccgactgcgcctgatgtctctgtgacatgacacggacgtagggggctgaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438378 - DNA, 2999 bp, Homo sapiens
aacatatttagaaacatattctccctctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438379 - DNA, 3376 bp, Homo sapiens
ccaaggaaggcagcagggcagggaaggtcacccccattttgcaggtggtaaaaccgaggctcagggggtgacatttctcagctataggagccagggatgagcttccggctcagggcttgagatagaggagaagcccccaggtgagggctgtcctgaacctaccaagggccaccaggggacgtggggagagaccggaaggagcggtgcaggctggaggagggaggtcattccaggagagagcacgaggcctgacactttgcgggagccctggaggaaacaggtggttgctggagcaggggcctcaggttgtggagagagatttccagaccaggttgccagaggttgcctcctgcttccccttcctccaaggcctgggtgggtcatttgtgcacctgtagctcggctcatgcgtcgctaaagtgaggttggctctgctcagaggcaggatgtggtgagggtctcacagtggcagggctttttccagcatctgcaaaccccacattttctgtgagcaggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438380 - DNA, 1750 bp, Homo sapiens
gctgggtcaatagtacttgccgcagtactcttaaaactagcgatggaggcttcgacatgggctttagggagtcataagtggagtccggaaagaggtatctgtactataaaagctattgtgtaagctagtcatattaagttgttggctcaggagtttgaagtccttgagagaggattatgatgcgacgtgagtgcgttcgtaatttgagtctgcttggcagatagtaatgaggatgtaagcccgtgggcgattatgagaatgactgcgccggtgaagcttcagggggtttggatgagaatggctgttactacgagggctatgtggctgattgaagagtatgcaatgagcgattttaggtctgtttgtcgtaggcagatggagcttgttataattatgcctcatagggatagtacaaggaaggggtaggctatgtgttttgtcagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggtagggccactgccgtggctcaggggttggggggccctgaggtgctcctgccccttaggcctgggccatctgcaacataagcacctcttggcccacaggggattgggccctgagcacactcaggtggcactgggacctctaagggctgcgtcccctgccgcaggctctggcaacatcgggaagggaaacggttagagccctgggctgaaggcctcttcaggtcttggtcctactggcatcttagatcctgagagtgggaagcaggagagagaccactggggcttggggtagccttcccccatctccagctgttgatctgcctctgaagctggcatcttagtcccatggagagcccacgctcgcctcctccagcccacgcctcagcaggccccccacagccgcactcacctgagtgagagggcctccccccaaccctctggggcaggggatgagtttcacagctggtcctgaggcagtctgtataattgctggtccattatccctgcccactgccctgtggcatgattgaaggaatccactcaggtgcctcaaattcctgcaaaagaaactacaattagagccaagccccatgcggcttggctatgtgttttgtcaggcgg

SEQ ID NO: 438381 - DNA, 3277 bp, Homo sapiens
cattccccgggttcccttcccaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccagggaagcagcgagctccgtgtagacctggtggactttgagggcaaccaccagtttgctaagtacaaatcattcaaggtggctgacgaggcagagaagtacaagctggtactgggagcctttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438382 - DNA, 2915 bp, Homo sapiens
ggccgatctctgaggatccccaacccgggaccgcttttgtcgggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438383 - DNA, 2947 bp, Homo sapiens
  misc_feature (62)..(62): n is a, c, g, or t
acgaggcagagaagtacaagctggtactgggagcgactttttgggtttcccccggggggggnggggaaggggggggggcagtgcgggtaattctctaacgggccacaacaacaacttcttctccaccaaagaccaagacaatgatgtgagttcttcgaattgtgctgagaagttccagggagcctggtggtacgccgactgtcatgcttcaaacctcaatggtctctacctcatgggaccccatgagagctatgccaatggtatcaactggagtgcggcgaaggggtacaaatatagctacaaggtgtcagagatgaaggtgcggcccgcctagacgggccaggacccctccacatgcacctgctagtggggaggccacacccacaagcgctgcgtcgtggaagtcaccccatttccccagccagacacactcccatgacgcccacagctgcccctttgcccccagctcagtcaagccgccacatgcccacaacctcaccagagggagaattatgtttctaaatatgtttactttgggacagaaaagttttaccagtttcagtgtgtgtttcttgaacaccagtggttttgatcactttcctgtgtctgttgcacggcaggtctttccctggaatttggtaagtcgggaagagtcaggaccctcatttagcagatggcactaccgatgttcagggaggttgagtgacttttgcgaggattttccacctccagtaattgacacagggcgatcctcacctccacccccaagcctcccccatccccccatgcctcactcacaacacttcacacttcttgaaaaaggtcactttggggtccagaaaacacttactaaaaagggggaaagtttagtaggaacttttctgcttcccaccacggcagagttcatgctttgggctggctggctgctgggaagagataaacacttagcactcactaagtgagcgcctggtcagccacctgcacagagaagattccgaagaggccttcctcccacacacagacctcagctagaggggaccgcggacctcagtgggaaaagctgcacaaggcttctaggagatgatggagaaggggcttctccagctcccaggccaggggagatttctcaaccacgacctaagaagcatcaaagggaatgtggcaagtgtgactccattcaaatcaagagctcccacttaccgaaggacactaagggaaccaaaggaaggccagaggggcagaatcaccgtgcggcacacaaatctttagttttctactattgccgcaaccagtcaccacaaatggagtggcttgaaacaacaagaactcgccacctcctggctcagtagatctggagtccctgggccttactgggccagcaggcaggactcagcagtggtggctccttccagggttctaggggagaacctgcttccttgccttttccagccccaggggtcactggcattcattggcccggactccttcccccaaccccaaagccagcagcaccacatctctctgacccttcatccgttgtcccctctccccccaagccccatgggacagggtctccactcctgagactcatgggattagactaggcctacctggatgatctgggatcctctcccatgtccaggtctctatccctaaccacatcagcaaagtctcttttgccatggaaggtatttgcaggctctgactttgtgtgtattagggcaggacatttttggcggggcagtggtgggggcagggaattattctgcctaccatgccttatacaaaaataaataaatcacaggcttatacctgaaagaattcctgcaaataataaaagaattagagcagctcagttaaataaaaaaaggtatgagatgtgaacagacacttcacagaagatgacatgcaggggagcaaggtatttatcaaaaagtgctccacttttcacttaccagagaaatgcaaatcagcacccaaaggagtcactgcggcaccctcatctgagcctcagaagttagaaagatggatagcaccagtgtcaaaggtgactgtgggagggagatttgcatacactgctagtaacaatgcgaattgatggaaccaacctggaaaatggcttggcatcaactgttggagaagaagacacacagtcctctaacctgccagtcccacatcagggcctggatatggccgtcatgtgtaccagggagcatggccaggaatctttacagccaaatactcaccatagcaccaaactggaatcagccgacatacccatcaggaagagaatggatgttaaaaaatgcaaggatagccattgggtagaacgccatacagccatgacaattacacagtgacacctacacacaaggagcatgagtctcacaaacatggcagcaaaaggagcctgttcaagagggtatgtgctatggattccattgtagataaagtttttcaaaagcaaaagtagccaatggtattttggatgcatatttaggtggtaaatgtatacaggaaaaataagaaagtgattgtatttgagggtgggaccacatggtgactgggaagggacagggacaagcctctgggattctggcaatgctctgtttcttgacccaggtggtgattgtaaggatgtttgttaactagtgatgaaaataattaagctgtacttttgctttatacacttttgagtacatgttatgttccacaatttaaaaactacttataaagaaatgcactccagcctgggcgacagagcgagattctgtctcaaaataaaagaagcaaagcaagcttatgaagagatgaagagtcttttcccatcaccaattcctccccaactcacatcagcagaactgagagagcttttgtgatttgagggataaagctgaatgggtgaaaagaaatcaagccctcctcctcttgggccagtgctcttctt

SEQ ID NO: 438384 - DNA, 1745 bp, Homo sapiens
  misc_feature (1369)..(1369): n is a, c, g, or t
gctgggtcaatagtacttgccgcagtactcttaaaactagcgatggaggcttcgacatgggctttagggagtcataagtggagtccggaaagaggtatctgtactataaaagctattgtgtaagctagtcatattaagttgttggctcaggagtttgaagtccttgagagaggattatgatgcgacgtgagtgcgttcgtaatttgagtctgcttggcagatagtaatgaggatgtaagcccgtgggcgattatgagaatgactgcgccggtgaagcttcagggggtttggatgagaatggctgttactacgagggctatgtggctgattgaagagtatgcaatgagcgattttaggtctgtttgtcgtaggcagatggagcttgttataattatgcctcatagggatagtacaaggaaggggtaggctatgtgttttgtcagggagttgagaaactgtggcacaaggcgagagctggtttcctctgccctgttagagctgggggactcttcagagtcaaaggccagagagcatggagctgagtggagccaccatggcccgggggctcgctgtcctgctagtcttgttcctgcatatcaagaacctgcctgcccaggctgcggacacatgtccagaggtgaaggtggtgggcctggagggctctgacaagctcaccattctccgaggctgcccggggctgcccggggccccagggccaaagggagaggcaggtgtcattggagagagaggagaacgcggtctccctggagcccctggaaaggcaggaccagtggggcccaaaggagaccgaggagagaaggggatgcgtggagagaaaggagacgctgggcagtctcagtcgtgtgcgacaggcccacgcaactgcaaggacctgctagaccgggggtatttcctgagcggctggcacaccatctacctgcccgactgccggcccctgactgtgctctgtgacatggacacggacggagggggctggaccgttttccagcggaggatggatggctctgtggacttctatcgggactgggccgcatacaagcagggcttcggcagtcagctgggggagttctggctggggaacgacaacatccacgccctgactgcccaggaagcagcgagctccgtgtagaactggtggttgccctcaggagtccacgacgtcttgtcataagtcaaaaggtccatgcagaggcatggagcatgaggtgggagaccaacgctatggagcctgggtgagctgtggcatgctcccttgcttagtcatatgatgtcgctgcgattagtccaatgatacgcgtggctgaccacaagagactgcgtgtcatacattttacacgagaaggactcnaaggactgagatggaagtcgctgtgagtagcggcctccatgatcgaataggcgttcgagccaagttttctctcccgggaggacctcgcccccgtggggtacctggcccgcgaggtgattccccactgggcggtgccaagaaacagcggtgcagcaggggctccagtcgtagcccattccagggagcggaagccacgcacggtagacgaaaccgctgatgtgcgctcacagcttggggtaagtcccacacccttgggagagctggggccgaggggaaaacaaagggttgttaagcggcgccctaaataagcgggcaatgaccccaggagggggagcaaggaaacacgtgggaactcgggcgtcgacagggaagcccg

SEQ ID NO: 438385 - DNA, 3400 bp, Homo sapiens
gggggtggtgaggtgggggcagttaggaccctgtatgttatgtaaaatagatttacaaaaaggacaagcatgataaaagggaatgaatggagacgatgtattattcagtttgaaagagatagttcacatttttataagaaaaatttaataaaacatatattttagttatcatttaacaaagatatattaaagctattcaggcaatgccacaggattctcatgaagggaaatcactgaacccttgtcatgagaaaatggtcatttcaacacatttcaatacattgtataaatttggagcttaaggtgagtgagtatgttttcacttagtcataaatgtttggtcaaaattaaagttatcatatggtttcacatcaatacaaatattgtcacagtgttacagaaacaactatcaaatggtaagatagtttacatttgtgttttctagaaacctttgtatttatgcttcatttggttaatgttaagtgctgataaaggcataccagattgtttgtcaaagtaaagaagcaatccatcacacctaggacatctaaggatggattatacgtcagagtggtctcatatacaaatgaccattttccttcagtaaaatcttgttggttgaaatgtaagtcttttcctaaagttttaatcagaggtagccatcactaagacttaagccacctgtggttctcttaagtttcactgaagccagaagaaggaaattaccacaacttgtattatactaattatcttcattattaacgatcatattagagccactgacatgtcccaaattatattaaaataaaaacctgcattgctctgacatgaagctcaattcaatgtaataaacaaattaggtattaaacgttataatttaaaaaacttctacgatatcaccagaaatcctggtgaaatttaattttttcccttttttaggtcagtggccggtgggatagatttttctaaactttttcctgctatgattttgaaggcaaatacatagagcacagttcagtaaaagagtttccaagccttttcactggagcatttacattttgattctgttgtcatttgaaatagaacatctgcagggagataatgagcttaagttacaattgactttggaaaaaataacagacttttgtgtttcctcaatcatgtagtcaatagggaattctccagttatgtgaacaatcacagtcttttaagacaatacttagatctaaatgcaaaatctagcatgcagaggctttttaaggattttagactgtctccaaagaacttggctcgagatggattacacagatttacaaatgcagttttcaactgtgacatcaaactgatcttatctcatttcatgttactcaactgtgcccgtaggaccccaagaggtggaatattttgtctacattattttaaacatctatagatatgtgtggatgtgtgaataatgcctaaatttctcatcttttaactagtttgtttttatcatacagacacagcctgttcataagaccagctttagacaacttagaactcaatgctctgaagattcagggaggccaacatagaaaaagatcttccaaaatatggggtggtccaacccatctcatccctctctagctggaaaactatagagaaagggctgtgactgccttgaccactgcctggcacaatgtaggcactcggtatttgttggatgaataagtggctgaatcagtgaatagacaaaaaacatggattttgccttctgaaaatctcacaaattttaccagcttatattatactgattgtcactatgatttctaagtttcatggttagaaccatattttgagtctatataaaaactttttagatgtatgaatttgaaatttcattaattactttaaaggcttcaaagatttgaggacatttgaacagtggataaggaacaatgtttggggatacagagtttttatgctgagttgaactcaacctttctagttctttatacaagcttcctgaattatctggcaggaatgattcaaacataaaaccccatttttaaattttataaaagatattttcatttttatataaaaagatcatcaggcatattatcccctttgatatttattaacaaccattctctaagaaattcataataattggagacaccatccctaaatctcttcctattttcaaaagatcatttatcctttcatatttgattcctggaatacactaagctgaagtttaatcacatacttactcagatgtttccatgtgtttattcatttaacaaatacttattgtgtacctagtgcatgctaggttctggaaatgcaacagcaaacaagacagacacaatccctcttggaggttactgtgagaaactctccaacatttactctagcaataactagagagtttactgtccattgggtcctcttcacacctgatagaaaaaataaaattcctcaccccatggaagtcatgaaatactccctgcacagatttgtgtgagcttgcttttctaaaaccactgctcaaaaatgctgcttagtttatctataaaccacggttataccccagtgaggtaggtaagtaatttattcataactaacatttatgcagctctattttctaggccactgtgctgagtgcttttatgggactatctcaccaaatcccttcaacaactctattcagtaggttccattttatagatacaaaaactgaagcacagatatattatgtgacttgtccaaggtcacacagctagcaggtggaactgggatttgaacccatgcaatctgacacaagagttcatgtgtctaatcattatctgtggtttgggggacaccattacattaaaatgaatgagtcactaagtgagtcactgtatataaaatacttggaaattgtaaagtaatatacaaaagatattaacaaagtattattcatggtaaacaaatcacatcagtagcaaacacagggtgggaactcaatcttatgttatagcttactcttaagaagaatatgtgaagccaggaacatggttaaaggtacagaccagaaaatttctgacatgtgataaatatttcagtgacttttcagatttatttcttgttagccgctgtgtctatttggtgctacaaaaactgaaagaaacaaaatccctgatgtaagggcttataataaatacacagtttggagatgaactaaggatattttacatttacgggaaaggattggacaatagtatcattttctcaccatttgcatgtacatcatgtctttccaattgttttcattatttttctgaaagagctgcaaaattgtgcagtggttcaacctgaccaaagtggtattatgctgctgggaagtaaaagtattagacaccaaaaagaagta

SEQ ID NO: 438386 - DNA, 443 bp, Homo sapiens
cattttgattcagctttaaaatgctatgatcatttgtatctgggtctataacctctaaaatagtaaagataagataattcttgtcttttcaatcagtgattaggaagggaaatccagaatactgtattgaacccttcctagaaacatcctaaaattattctgcttaatgagttgatgttagatgttccacttaccaacctgttggcctgattataatatgatctttatcaaaaaccagtagatatatagtatgtaaatggaaacatcacagtatcctagatcagaccgcagtagttgctttcaaaaatggctgtctctttgaaaaagttcatgccatcctcttaaacgtttttttatcccagactaattttctgctcaactgggtatttgggcagcatgcattcatttactctgtgtttatgtgatttgtgtgtacatggaaa

SEQ ID NO: 438387 - DNA, 1587 bp, Homo sapiens
gtgtggaaagaagagggctgtgggaagcaggctggtgtttcaggcttcagtctgaccagggccttggagctatggaggagaggtataaggaaatcaaagcaggggcctttgtgattatggggacagggtggctcctgagagaaataggacaatggagttacttaggaaaggtgtcatctctctgccgtcctcctgcccagcctcctcaccagatgcagccacttaaaaaaatttttataatagctttattgagatggtactgacatattataaagtttatccttttaaagtgtgtaattcagtggtttctcgtatagtcacagaattgtgcaacaatcaccagtatctaattctagaacattttcatcaccctaaaaagaaatcctgtacccattagtagtcactccctgtttcccctactccctcccaaccactagtgtactttctgtctctatgaatttgcctagtctggacatttcataaaaatggaatcataatatggcacagccttttttgtctggcttttttcacttagcataatgtttgccttctcaagagttacccatattgtagcattgtgtcaatatttcttttaatgtaatgtaattacaatgtaaatgtaataagtgtaattacaatgtaattacattgttaaaaaatgactgaggcagccatttttaacttcctgttttcagttttttagagttgtctctgtatttctaaatgggagattttttaaattggttttttcctaattcattaaagttatatttactctgttaactccctgctatgaaagatgaagaaaaagagttcattaccttatttttaggtcttttatttttaagttaagataatgaatcaagcagatgtgagatacttggatataaaacaagatttaaaaatgatgtctctactttgtgcctccccctcaaattaaaaaatattattgaaaccgcccacagtttcaaatctggtgggtgaagtgcatcataagtatgctgttcccacttggcagtgttgctatccctggtccaggtgagatgggaagcagaagggcctgaaccatatgatgcaaggtgattgttgcctggcatcagaacttgggcaactatgaggtttgctgctcttacaatgtacagtcattattaaatcctaagacagaataatcagtagtgaagctagactagcctgaaagatggcccctgaatcagactctgaggagtagaagttagctgtaataaaacactgcgaagaagccctgttaaccaccatgctacactctgctgttaatttatgctaggctttctgagaattatctaagttaatgctgagaaaataaaacagaattaaaaataacaacaccctccaatgtctgaagagttgtgatttctgataacatgctcctggctggcccccctccccacactctggattttttcctgtgggaaactcggatttgactgctgtgtgtttttaactaagtgagatcttcaggaatgcaaaagaaccctgtgtccctttattgttccctccaagttaagtatttattgaaataaagcatttatctggtgaaaacatcaaatg

SEQ ID NO: 438388 - DNA, 7866 bp, Homo sapiens
tgactgcatcacctggtctgtgaattttccattagaagcttggtgtgctgttaggtgaaagacttgctcagctatgcgtcattgggttttatcaacatataggcgaaaaaaatcctggtctctgagtgtacagctgagatgaaaatttcttttattggaggaagtattgagtgtgtgctctcaaatgcggcctcagttgagtagtgcattcctgagttttggaagcaaatttgcaaacaattgagagtcgtacagtgggtgttctaactggattcaggttttttctaatgtaattttttcacacgtaaattaaaaagtttagaaatgtcacacataacttcataacactttatggagaaatggttgtacttttaatttttttctttttatttatactccaactgactgagcagaggttgtacttctaaataactttgtggaagtttttagtaccataatttttataattttcattccagtcctttgatatttatgacagtacttctgaagcgcttactgagtgccggacactgttgtaagtgctttacggaacttgacttttttttttttttgagacggactctcgctctgtcgcccaggctggagtgcagtggtgcagtggctcgatctcggctcactgccacctctccctcatggtttcaaacacttctcctgcctcagcctcccaggtagccaggattatagccgcccgccaccactcccgactaattttattttgtatgttcttttttagtagagacggaggagtttcaccatgttggccaggctggtatcgacctcctgacctcaagtgatgtgtccatctcggcctcccaaggtgctggaattacaggtgtgagccactgtgctcggcctaccttttttttttgttttttgtttttttgaaaaggagtttcgctcttgtccaggctggagtataatggtgcgatctcagctcaccgcaatctccgcctcccagattcaagcgattctcctgcctcagcctcctcaggagctgggattacaggcgcccaccgccatgcccggctaatttttgtatttttagtagagacggggtttcactatattggccaggctggtctcgaactgctgacctcaagtaatccgcctgcctcagcctcccaaagtgctgggattacagacgtgatccaccaggatcacaccaggccgcgcctggcctgctttcattttaaaagtcaaatttgtcatccgcctcagtgcttgtaatcttttctgagtgagatactgaaatttgcagtttcgttttgcttgcacttgttcactggaccagtagtcactgttaaatgtaaaagtatctacttcctctgaaagttttttattcctttatttcctgcctgggcttgtcctccaccctacatgtatgcgtagtagatttagtgtttgttatcctaacctttaggtttagggattgactgggtttctgactttttatttggccaatgaggacgatacagaaaatgaagcattggtcattatcacattttaacgctgaaaaagtaagaaggacaaccccggaataaaatgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438389 - DNA, 6466 bp, Homo sapiens
agcggattgagtcaccataagtggacaaggaaggagcttctaacagtgatatcagtatcaagataaaagtttggaatgggagaaaaattctcaaagcctgaaagaaaatctgagatgcttggagtgtaaagatcccatggtcacataaatccggaaagcactgaatactttgtttcccataagagaatcccattatatgttgatgtattaaaagacctgagaacctggtgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438390 - DNA, 6607 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagttttggagtccagaacatgtaaagttttttcacccattataaacaatttggacaaaatgctgcatgttctacttaaaattgggagctaagcagtggtagagatggggcttcaccatgttggccaggctggtatcgacctcctgacctcaagtgatctcccaggcttggccttccaaggatttgtgcacatataaacttctgtccatgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438391 - DNA, 6331 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacaggtagttacttttggtgacgctgtccagttcccacaatgtatcattccttatctgaaactagacatcctctgcagccagaagaacaagaagtaggcattgaccccttgtccagttactctaacaagtctggaggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438392 - DNA, 969 bp, Homo sapiens
gagctcggtacccaattagctgcgcacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438393 - DNA, 2355 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgtaagtatttaaggacagttttctcttcgttcttcattttcttctctagagtgctgcatttatgaaagctctgttagtgcccagttttataaagctcttaaaacttttatggactaaaaggaattattttatcaaaagtattttattattttactttagtaatattttaaggctgtagcctatattacactggaaaaaaaaaaaagtagcatcattttaaaataagttgaatctttcccaaatcccagtcctttttttctctacaaatgcctttttgtcaaagcctgtgttttcttataaaatttaacagataaatgatggaacttgaaacaaaccaag

SEQ ID NO: 438394 - DNA, 331 bp, Homo sapiens
tgttcccccagggaagccagcatttggcttcagaggggctcacaagatgctgctggcactgcaccactggtaaacgtgtgggcttcagggcagcaggccaaacactgcgtctttcaaggtcgaatgtagggtgaggtggcctagctttccaccacgagtcccccagttcacagggccttccactcagttctttgccagtttcttctttcatccacctgtacttctgactgtacttcacaggcctcttcagaaacgccagggtgcactgatagagggaattccgatgacttcatcctgatttccaaagatgatgatgggagcagtgccaggg

SEQ ID NO: 438395 - DNA, 3285 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctggggga

SEQ ID NO: 438396 - DNA, 6466 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438397 - DNA, 6525 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagagatggggtctcactctgtcatccaggctggaatatagtggcacaatcatagcccattgtagcctccatctcaaggactcaggggatcctcccttctaggcctcccaagtagctgggattacaggtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaagacattctaaaaggttccctgcgttttaaccagagccagctagaggccgaagagaacgaacagatcaccattgcggacaaccactactgctccagcggccagggccagggccgaggccaaggccagagcgttcaaatgtcaggggccattaaacaggcctcttcagaaacgccagggtgcactgatagagggaattccgatgacttcatcctgatttccaaagatgatgatgggagcagtgccaggggctccttctccggccaggcccagcctcttcgcaccctcagaagcacctctgggaaaagccaggccccagtctgctccccactggtgttctcagatccactgatgggcccagcctcagcttcctccagcaaccccagctccagtcctgatgacgacagcagcaaggactctggcttcaccattgtgagtcccctggacatctgaccacagtgcccagtcctgccccacagggatctagccacccttcagtggccccaaggccagactgaggctcatccagtggagaaccttcttaaaccactgcttccttcccggcatgcatttggcattggtccagccctttgaaaccccttagagagaagcatatatggccacaaagcacagaggcttaggtttgccacatgcagacagggctttctgggcccttacctaatccccacccgactcttgctctgagttagagctgagttacgtacccagtatcacactcacagttagaaaagaccgaatcacaatttagaatcacttttcctctgtccccttctccccagctaagaatgtgtggcacctccatcagttatacttagaaggagcagaaatagttattttcgtatcttctatccctcaaagcatcagacatgggaaaattggtttataccaagaaagcttcctctgtggaaatctgtctcagcctactttattcctgcattgggaagccatatcgcagagctaaatgcaatagaatgaaccagaactagtggattccagggctgggggaaaaaaaaaaaagaaaaaacctcattactgacctctcaaagttataaggatctctgcaaacaggatctaagcttaggaataatatttaggtgtgatatagtgttagatttttttgatgtattaaagaatgcatctccaatccttaggccatatcaactttggccatcaatatctctccttaaacaattatatttcaccttttagaatctttcatagccagaaaacaagattactgtaagccagttttagctgcactgatttcaaaagatataagaatattactatccttcaaatggaaaatgcgaccttgactttatgggataaacatctttcagacagtcagttttctagtcaggtttctctggtttcagagctgtatatacctgtcaactgaggaataaagggaaaaacccaagttcattcccacccaaagtcagaatccctcattggccttaaggtagcagtcataagacagagaattggacctagagtcccttctgtggggaataaggatacctagagaacattccacatgccaagaggatgcaggatttctacacaaccccttcccttcttggaagtcaagtgtaggtactgcagggcctgtgctcagctgtgaaccccgtatcctgggccccactgccgggaccgggtctgacatgccagtgccttcctgggctgagcacagattagagactctcccccttgtcagtcagcaccttaggaaaccatgatgggcacagagcatcacatgagctgtttctctccttaaagaagatccctggaaaggatgcttttcctctcctttgcctgcgcaggaattctaacaggagtgggtgaggatggcagagggacacagtgcctgtctcgcctccatcagggagagcagccatgccagggatgactagctctttgagcctgtcctcagaggatggcgaggcagccgggcagtggaggccttcatggtaacaaatgaaagctcagtatagaggaacagacactgtttacgtccctcccactgctaaccttatatatctctatagacaaatgtgataatgacatgatttcccacctgccctccaagaaaatggtgactcactctcaagtcagctactgtagagagggttctaattggttctgcaatttgctcttaaactctagcagggaactctcctcttaccacatcagcatgtaaggtgaataataactctggttttgccagacagcaggttgtctgaccttcaaccactgggcaattgcctggcagatgcacacagtagctccctggcttctggctctgagtgttcctctcagcacctctgagtaagctgctgccaagcacatatccctatgacaacactttgtaaaagccgcggggcccccatacagcgagtgaccttgcaactgtgcagggttgccattggtcactttctcaccttgggaaggtgtcagtgttttcagttctaaggtaagaggtgtagagctgttcccaccagggctctgggacagactggaaaggaccacagacctggccatccctgggcagcagggccagtgtcacctgctgacctctagtatttcctttgccctagagctagagtcatgatagctgagggtcactcgccctgcaagagtcactaggcacccaccatgccaataaggctctccgctggctccctgcagttggctgggtgtttaatagtcactgaaaactcccagccctgctgcacactagaggcaggtcctctcggtcctctccatcctgtgcttctgtggcccccagcaagctcaccgcctccttggaggagagagacatacaaggacagtgggtcatgggtagtaccagcctcaaattcccacaggctcatactcagacaattgtattactgccttatgttttttaagtgtttttttaaattcttcatagttgagtattatttgcaattttattagttacagtgctattaaagaatatgtgctcctttttattatattatcagatacttatgtttaattgtacattttttaaatcctgaatatattgtgttttgttaacaaatgtaatcagtggaacccttcttacgttttgattattagcagttaaatacattttgtatacatgaagcttagattaattcccatcatcatcatctcctgtttttatatgtgtccctatgtgtttcatgcattcctctttgatcagattggaatttgagttaaaatttagctttgtacattacgtgtgagagttacagactagcaagtctaattactttgccttaccttgagtgtatgccacagggtcagataacacattaaacatttagttacactggattactcttccaaagctgacctcctgctaatgttcagaggtaactgcaatccggaaagaaataatatcactgcagaaagaatgtgactctaaaaataaaccaggacctccctgtgatttgccttgcctgcagatgaccagttgactcttgtgctgtcagccctggggttgctaaggaagctgcttcagggagttgggggttagttgcccgctctcaacaggaatgcctcctctactttgtcagagatgctgaacaaatatcaaactctgtggcagtcatgctggcctcctaagaataacctgtgagtcagagttgatgcacattatttttgtttttattttatttttttaaggaactgctccaagggttcattatagaacaggagtgtgtacggaggacttaggtccccacatagagtggccgttctgtggcggctccaaccaattccatccctcctttcctgcggacacacacctggcccctggcccctgccctgtgtgtctggaggaggggcactggggaggctgtggagcagagagaagaggccggatacattgaggatggcacctggcaagccaggcttccttctcaaaggccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438398 - DNA, 2628 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttaaggtgggtgcggctgctatttggacgagagttccccctgcaggaccttctggtggtctgggatgccttgtttgcagacggcctcagcctgggtttagtagattatatcttcgtagccatgttactttacatccgagatgctttgatctctagtaactaccagacctgtctcggccttctgatgcattacccattcatcggggatgtacactcactgattcttaaggctctgttccttagagatccaaagagaaatccaagaccagtgacttatcaattccatccaaatttagattattacaaagcacgaggagcagacctcatgaataaaagccggaccaatgccaaaggtgctcccctgaatataaataaggtctctaatagcctgattaattttggaagaaagttgatttccccagcaatggctccaggcagtgcaggtggccctgtacctggaggcaacagcagtagctcctcctctgttgtaattcctaccaggacctcagcagaggccccaagccatcacttgcaacagcaacagcagcagcagaggctgatgaaatcagaaagcatgcctgtgcaattgaacaaagggctaagttctaaaaacatcagttcatctccaagcgttgagagtttgcctggaggaagagaattcactggctctccaccttcatctgctactaaaaaagattccttttttagcaacatctcacgttctcgctcacacagcaaaactatgggcagaaaagaatctgaagaagaattagaagcccaaatttccttccttcaagggcagttgaatgacctggatgccatgtgcaaatactgtgcaaaggtgatggacactcatcttgtaaatattcaagatgtgatattacaagaaaatttggaaaaagaagatcaaattctggtttccctggcaggattaaaacagatcaaggaccttctggtggtctgggatgccttgtttgcagacggcctcagcctgggtttagtagattatatcttcgtagccatgttactttacatccgagatgctttgatctctagtaactgccagactgctttctcagtgttacttactaaagctctctttttatactgttaaaaagatatataaagttcgtataaacaggcttgagaccactttgatgtaaaagctgtcatagtagtttttctcacagtggcacaattcatttgattgatggaatattcagtgacgccatgtatgccctatcgcttttttctcatccatctttatgctataactcatactgatttaagaaatgatttctccttttggcaaagcgaccccattcaatatggttataataaaagactaatgtcaaaaactgaacaaaagctt

SEQ ID NO: 438399 - DNA, 1680 bp, Homo sapiens
gctggtcaccgccgccaccccctcccgccctgttctctttcaggtcgggccgggcccggccgcttccgcgagcgccctgcagactgagggagagagagagaaagaggaggggaggaggaggaggattcagggaataggagctggggagcccttctgcgccacagtgatatcagtatcaagataaaagtttggaatgggagaaaaattctcaaagcctgaaagaaaatctgtagttacttttggtgacgctgtccagttcccacaatgtatcattccttatctgaaactagacatcctctgcagccagaagaacaagaagtaggcattgaccccttgtccagttactctaacaagtctggaggagattcaaataaaaatggaagaagaacaagttctactttagactctgaagggacttttaattcctataggaaagaatgggaagaactatttgtaaacaacaattacttggcaacaataaggcagaaggggattaatgggcagctgagaagcagcaggttccgcagcatttgctggaagctatttctttgtgttcttcctcaagacaaaagtcaatggataagtagaattgaagaattaagagcatggtatagcaacattaaagaaatacatattaccaacccgaggaaggttgttggccaacaagatttgatgatcaataatcctctttcacaggatgaagggagtctttggaacaaattcttccaagataaagaacttcgatcaatgattgaacaagatgtcaaaagaacgtttcctgaaatgcagtttttccagcaagaaaatgtgagaaaaattcttacagatgttcttttctgttatgccagagaaaacgagcagttgctttataaacagggcatgcacgaactgttagcacctatagtctttgtccttcactgtgaccaccaagcttttctacatgccagtgagtctgcacagcccagtgaggaaatgaaaactgtcttgaaccctgagtatctggaacatgatgcctatgcagtgttctcacaacttatggaaactgctgaaccttggttttcaacttttgagcatgatggtcagaaggggaaagaaacactgatgactcccattccctttgctagaccacaagatttagggccaacaattgctattgttactaaagtcaaccagatccaggatcatctactgaagaagcatgatattgagctttacatgcacttgaacagactagaaattgcaccacagatatatgggttctgcccttggaagaatttggaaactccaagggacaacactttagtgaaatgagaatttatttgtgcttggcacagtgttctaatgaagagggtttcttgggctgctttgttttgtgaggaggtggccagtgaggaaagagaagattgatgatagccagcaccttggaggatgcttttgattacaagcttcagaatatcttgcctcaaactagctgaagtctggaggtactgtgacacaagaggctcaattaaggatccaagattttcgccatatttccgctgtgttaacttcatcatcagtttcttaagacatactctcttgtaatcacaaagtgattgacaatgattttggagctataggctttcttgttctagccaaactggtgagacagaataaaaccgttcaccaagtacaacgtaa

SEQ ID NO: 438400 - DNA, 1511 bp, Homo sapiens
  misc_feature (1)..(1): n is a, c, g, or t
ncacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438401 - DNA, 2180 bp, Homo sapiens
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcactctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438402 - DNA, 1440 bp, Homo sapiens
  misc_feature (1)..(1): n is a, c, g, or t
ncacagcagctgtggctggggagcccagatgaagtgtggctctatcttgtatgtgagcacacccacattttcactgccattatctgggacagcagaaccaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438403 - DNA, 1097 bp, Homo sapiens
ggctcgcgagcagatacaggcacaaggcatccccatgtggggtggggaggaaagggttgatcctttccatctaatgtggttctagaaacctcatggattccaggcaagaagcttagcactgtactctgggaaggggaatattgcaccttgtttctttgtttttcctaggagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438404 - DNA, 2040 bp, Homo sapiens
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcactctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438405 - DNA, 2150 bp, Homo sapiens
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcactctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438406 - DNA, 1454 bp, Homo sapiens
  misc_feature (1)..(1): n is a, c, g, or t
ncacagcagctgtggctggggagcccagatgaagtgtggctctatcttgtatgtgagcacacccacattttcactgccattatctgggacagcagaaccaggtttggctcaacagatttctctttccacccatctattgcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagttccaccctatggtggattcttctacatcacgcttggaattcattaactccataatcctgtttctgaggaaccataactttgatggactggatgtaagctggatctacccagatcagaaagaaaacactcatttcactgtgctgattcatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438407 - DNA, 2123 bp, Homo sapiens
cctctggctgaaagtagccggaaaggcctggctacttatgggctaagggttttgaatctgggctgcagattgtgcagagagttaatttacaaccttagaacagtggacaatgcttgatagtgtcagactgtgggcactggaaaccggctggtctcaggatagggatcctatacctccaacacttggattgctgacctttcacttctcaacttggtcaacggaagtcaaaaaccccagcaaggccacctgctgaattctagaacttccaggacttcccgacctagagcacatggccaaacactttctgcagccaggatgtcactgccctcccctgattaagataaatagacttggcctaataattatccaaatagattaattcttccaacaaaagaaagagttctggaagtcaatacccaatagccttctttcctgatggtgcagtagagagcaaaatccatctctaagcccagagttcgtgatattttggaaatagctacaatggtgaatttcaccccctggagagttctgtcactggcacttgttccagggttccagcagagtccctcttctcaaataggaagcactggctcagaagactgtccccagcataagatggagtctcactctgtcacccaggctggaccatgagtgcttttttaaacctcattttaaatctgaaagaagaatgaatacattggacaggctgtcgaaacctcagtggataaaagacctagagaatgtgtatcccagaagaagctggccaaggatatgggagcaaccaccatggaccagaagtctctctgggcaggtgtagtggtcttgctgcttctccagggaggatctgcctacaaactggtttgctactttaccaactggtcccaggaccggcaggaaccaggaaaattcacccctgagaatattgaccccttcctatgctctcatctcatctattcattcgccagcatcgaaaacaacaaggttatcatcaaggacaagagtgaagtgatgctctaccagaccatcaacagtctcaaaaccaagaatcccaaactgaaaattctcttgtccattggagggtacctgtttggttccaaagggttccaccctatggtggattcttctacatcacgcttggaattcattaactccataatcctgtttctgaggaaccataactttgatggactggatgagttagcagaagcctttcagaaggacttcacaaaatccaccaaggaaaggcttctcttgactgcgggcgtatctgcagggaggcaaatgattgataacagctatcaagttgagaaactggcaaaagatctggatttcatcaacctcctgtcctttgacttccatgggtcttgggaaaagccccttatcactggccacaacagccctctgagcaaggggtggcaggacagagggccaagctcctactacaatgtggaatatgctgtggggtactggatacataagggaatgccatcagagaaggtggtcatgggcatccccacatatgggcactccttcacactggcctctgcagaaaccaccgtgggggcccctgcctctggccctggagctgctggacccatcacagagtcttcaggcttcctggcctattatgagatctgccagttcctgaaaggagccaagatcacgcggctccaggatcagcaggttccctacgcagtcaaggggaaccagtgggtgggctatgatgatgtgaagagtatggagaccaaggttcagttcttaaagaatttaaacctgggaggagccatgatctggtctattgacatggatgacttcactggcaaatcctgcaaccagggcccttaccctcttgtccaagcagtcaagagaagccttggctccctgtgaaggattaacttacagagaagcaggcaagatgaccttgctgcctggggcctgctctctcccaggaattctcatgtgggattccccttgccaggccggcctttggatctctcttccaagcctttcctgacttcctcttagatcatagattggacctggttttgttttcctgcagctgttgacttgttgccctgaagtacaataaaaaaaattcattttgctccagtaaaaaaaaaaaa

SEQ ID NO: 438408 - DNA, 349 bp, Homo sapiens
ctcccaaaagtgcggggattacaggcgtgagccaccatgccttgccaacagttaggtgtgttaggtttagtccatataagggctagaacttcccttacacttaaatcttaaaaggaaaatattttcttaagatttctttttttaaacattaagtggtgcattaatcttttttctatagcctaatatgcaaatctgcctactttgagtaaggctaaatagcttcaggcttcttctgtaggcgtgagttgaacttcagttgagtgtttggaagatgtttgtcatcagtcactagagagtgaccagtcagtacaaaagcattccctactagaaaaatagctgtgtccacagc

SEQ ID NO: 438409 - DNA, 1206 bp, Homo sapiens
  misc_feature (3)..(3): n is a, c, g, or t
  misc_feature (5)..(6): n is a, c, g, or t
ggngnngcaccatgttagccaggctggtctcgaactcctgacctcaggtgatcacctgcctcggcctcccaaagtgctgggattacaggcatgagccatcgcatcgggccgagaatgttagatctcttaactttggtgtcgtggaagcagcatgggctttagagtcaggcagatctgggttcaaatcctgtctggcagtctagtggtgtagcttctttctggtaagaaacctacctttcctgatgctcagtttcctcatctgtaaaatgggaacaaaaataacctgttttgtggagttgttctgtgacggtggttctcatgtgtggtagctggggcagcaccagcagcagtggcggcctcagcatcacctgggaacttgtcagaaatgcaaattctcgggcttcaccctagacctcctgaatcaggaattctgggaatgactaggcaaactattttcatgagccctgtaggtgattctgaagcttgttcaagtttgagagtcactgacctatggattaaggtgagtgagtgcacctgtgacagaacaagtgctcactgctcttggtttccttattaaaagagggagggagttgaaatggggtagctctcagattgcctctctcctgttttattttgtgattctcccttttagccatggaattgggggaaggaaagaggaaccatttgtctatcacaaactgtcccagagtcttccagatttcacgtttggaatgaaagtctcaggaaggcacggactttgttttcttcctcatgtatggcatagagcagcggtccccaacccctgggccacagatcagtatcgttctgtggcctgttaggaaccaggctgcacagcaggaagtgagcggcgggccagcaagctaagcttcatctgtttttacagccgcttcccattgcttccgttactgcctgagccccacctcctgttagatcagcggtggcattagattctcataggagtgcgaaccctattgtgaactgcccacgcgagggatgtaggttgtccgctgcttatgagaatccagcacctgccgatctgtcactgttccccgtcaccctcagatgggaccgtctagttgtaggaaaacaagctcagggctcccactgattctacattttggtgagttgtataattgttatgtattgcaatgtaataataatagaaataaagtgtacgataaatgc

SEQ ID NO: 438410 - DNA, 1533 bp, Homo sapiens
  misc_feature (3)..(3): n is a, c, g, or t
  misc_feature (5)..(6): n is a, c, g, or t
ggngnngcaccatgttagccaggctggtctcgaactcctgacctcaggtgatcacctgcctcggcctcccaaagtgctgggattacaggcatgagccatcgcatcgggccgagaatgttagatctcttaactttggtgtcgtggaagcagcatgggctttagagtcaggcagatctgggttcaaatcctgtctggcagtctagtggtgtagcttctttctggtaagaaacctacctttcctgatgctcagtttcctcatctgtaaaatgggaacaaaaataacctgttttgtggagttgttctgtgacggtggttctcatgtgtggtagctggggcagcaccagcagcagtggcggcctcagcatcacctgggaacttgtcagaaatgcaaattctcgggcttcaccctagacctcctgaatcaggaattctgggaatgactaggcaaactattttcatgagccctgtaggtgattctgaagcttgttcaagtttgagagtcactgacctatggattaaggtgagtgagtgcacctgtgacagaacaagtgctcactgctcttggtttccttattaaaagagggagggagttgaaatggggtagctctcagattgcctctctcctgttttattttgtgattctcccttttagccatggaattgggggaaggaaagaggaaccatttgtctatcacaaactgtcccagagtcttccagatttcacgtttggaatgaaagtctcaggaaggcacggactttgttttcttcctcatgtatggcatagagcagcggtccccaacccctgggccacagatcagtatcgttctgtggcctgttaggaaccaggctgcacagcaggaagtgagcggcgggccagcaagctaagcttcatctgtttttacagccgcttcccattgcttccgttactgcctgagccccacctcctgttagatcagcggtggcattagattctcataggagtgcgaaccctattgtgaactgcccacgcgagggatgtaggttgtccgctgcttatgagaatccagcacctgccgatctgtcactgttccccgtcaccctcagatgggaccgtctagttgtaggaaaacaagctcagggctcccactgattctacattttggtgagttgtataattgttatgtattgcaatgtaataataatagaaataaagtgtacgataaatgcaatgcgcttgaatcatcctgaaactccccccacccaaccccagtctgtggaaaaattgttttccaggaaaccgttccctggtgccaaaaaggttggggaccactggcatagagtaagggcttggtctctaggcacagcctgatactacctttggaagcaagatgctgaatccctccatgcctcagtttcctcatctgtgaaatgctgatagtaacatgagtcaattaatataaagtacctggaacacacagaagtgtttttattggtctagtgcccacactgtgcttggcacttggcaaaagatgaataaacatttaagaatgaaca

SEQ ID NO: 438411 - DNA, 1657 bp, Homo sapiens
ttgagcccaggagttggaagcttcagtgagctgtgattgtgccactgcactccagactggacaacagagtgaaaccctgtttctctaaaagaaaaatgtatggccaggcatggtggctcatgcctgtaaacacagcattttgggaggctggtctcgaactcctgacctcaggtgatcacctgcctcggcctcccaaagtgctgggattacaggcatgagccatcgcatcgggccgagaatgttagatctcttaactttggtgtcgtggaagcagcatgggctttagagtcaggcagatctgggttcaaatcctgtctggcagtctagtggtgtagcttctttctggtaagaaacctacctttcctgatgctcagtttcctcatctgtaaaatgggaacaaaaataacctgttttgtggagttgttctgtgacggtggttctcatgtgtggtagctggggcagcaccagcagcagtggcggcctcagcatcacctgggaacttgtcagaaatgcaaattctcgggcttcaccctagacctcctgaatcaggaattctgggaatgactaggcaaactattttcatgagccctgtaggtgattctgaagcttgttcaagtttgagagtcactgacctatggattaaggtgagtgagtgcacctgtgacagaacaagtgctcactgctcttggtttccttattaaaagagggagggagttgaaatggggtagctctcagattgcctctctcctgttttattttgtgattctcccttttagccatggaattgggggaaggaaagaggaaccatttgtctatcacaaactgtcccagagtcttccagatttcacgtttggaatgaaagtctcaggaaggcacggactttgttttcttcctcatgtatggcatagagcagcggtccccaacccctgggccacagatcagtatcgttctgtggcctgttaggaaccaggctgcacagcaggaagtgagcggcgggccagcaagctaagcttcatctgtttttacagccgcttcccattgcttccgttactgcctgagccccacctcctgttagatcagcggtggcattagattctcataggagtgcgaaccctattgtgaactgcccacgcgagggatgtaggttgtccgctgcttatgagaatccagcacctgccgatctgtcactgttccccgtcaccctcagatgggaccgtctagttgtaggaaaacaagctcagggctcccactgattctacattttggtgagttgtataattgttatgtattgcaatgtaataataatagaaataaagtgtacgataaatgcaatgcgcttgaatcatcctgaaactccccccacccaaccccagtctgtggaaaaattgttttccaggaaaccgttccctggtgccaaaaaggttggggaccactggcatagagtaagggcttggtctctaggcacagcctgatactacctttggaagcaagatgctgaatccctccatgcctcagtttcctcatctgtgaaatgctgatagtaacatgagtcaattaatataaagtacctggaacacacagaagtgtttttattggtctagtgcccacactgtgcttggcacttggcaaaagatgaataaacatttaagaatgaaca

SEQ ID NO: 438412 - DNA, 894 bp, Homo sapiens
ccagaagcttgatataccacctagatcactaaggaaatcataacacttctttcatgttctagagcccaccctagtgagtggatagcccacaagctcatagctagactcagtgaactgtgataaggaagatggtggaaagctgactagtgtggaggtgagtgaggtcagagagaagacagatctgaagaggattattgatgagatcattatgaagggcatgctgaaacttctaatatgaatagtccagatttagataaaagggaatgtagaagtagcccaaacttcagtaactaacatttcttatattatgtatttatgtgttcacttatttatatcaacactcctatcccatcttaatgcatgttagttttttgtcttatgaccctctgccacccacttctaagacccattcttaatttgttacatttgaataaatatctttcaaaaaacaaagtagtagcacaaattgaccacagtattcagtaaagctaaattcccctttttgccacagtataaagtcacttattaaggtctatgaatggtgctatattgaaccaatacattttcctttacatgtacctatttatcctttcatatttcaccaaatatttactgagctcctagttagataataaaccaccttatcactggtcagttaatatttattgaatatatttggtgtccctagcaccattcagatgtattttttactgctaatgtctgtcatttacaggtgtgttaatagccattataattgttatgaggccagaatgatcactttggatagagatttttaaaatgagtttttactcattataaaattataataattgacattctcatttgattttgataatattgataattgatgaaatgatcattgtagaaaactgc

SEQ ID NO: 438413 - DNA, 1790 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438414 - DNA, 336 bp, Homo sapiens
cccagatcttattctacatgcagtggaaacttgtatgacttaagctttttggaaaagcagaaccttttttcgtggttcaagaaatcaaagtcttcccgggaggtctttctgtaaatccagagctgcagatgtttgaccgtgttcagagaggggcccttgtgctgggtgaagtggatggggcacagcaggcaatgggtgaaaagcaggacaacctggggccctgggaggaccagggagggcccatgtctttgactgttcatcagccggctgacttcctgtccgcctgtcgtctgctctgcccatccatccgtagtccttccgcctgtctctgctggt

SEQ ID NO: 438415 - DNA, 299 bp, Homo sapiens
cccagcagagggctccgagagagctgcagcggcggtgggggccccgcagagattggggcccatggtttgaaggctgttcacaggcaccccgagacagcgtcccccctctgggcgcactggatttgacgttgcaggacgcgcggctggaagccccccaggccccgctgctcacagaccgggactccgcctccggttcccgagggcgtggcgaggcgctgcgggacgcccaacaggtgcgtgttgtgtccccaggccccgcgctccgggtggagtcaagagcctggaagccggcagcccgg

SEQ ID NO: 438416 - DNA, 276 bp, Homo sapiens
gcataataggggttggggccacgatgccctgtccttgaccctccaaatttctaggttggccacactgggtatcaggaaggtcttcaagacccgaggacatgaatcctgaatgctggctttttgggcagcagcggaggttctgtccagtcccaggactgtcggcgtccctcttgccagggccacctgctctctgccgattgccatctccagcatgttggacaatcttcactggactctttgaggaagaaagcccctcttttccctttccaccccatg

SEQ ID NO: 438417 - DNA, 1885 bp, Homo sapiens
ctgactggcacagataacatactacgcgtgtcttctaatggctacgctgagtgccctggtgctgtgcgacattctgtgcactgatgtgcggcactgcctctgcgtctgtaacgtgctgtgcctgctgtgctgtgtcatgtggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438418 - DNA, 2748 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggtgagtggggttgcccaggaccccgggcatacggctgccgtggcaggaggtggtgcctcgggggacagtacctgcccatgaaggcaaacagggtgcacatgtgcgtgcaacagtgtggctcacatgtatgcgtgcaacagtgtggctcacatgtgtgcgcgcagcaggagagcgagtgtgcccgtgactgtacgtgtggtgggggggggttgaggaacagggggggtgtgggtctctctcggtgagggtgtcttcccaggaggagttgctgggccgactctgccaggcatctgtgtccctggcagggtcttccccaacacaccctgcatgacaccttcgtcactaaaatcagcctcgtgagctggcagggcaaggaccctgttcctttactcagctgagaaaaccagagagggtggtggcctgtcctgggctctgaggcaaatcaggcagaagggttggatgcctgaggtcctcctcccacccaccaggcctccagacctccgggcacctggagacctctcggtatcgcctctgccctcctctgcaggatttgctctgggccgccagcttctatgcccgcttcttcttatcctacctccccttctacggcgtccctggggtgctgctcttctttgttgctgtcagaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacaggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438419 - DNA, 2291 bp, Homo sapiens
  misc_feature (2222)..(2222): n is a, c, g, or t
  misc_feature (2225)..(2225): n is a, c, g, or t
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacaggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgtaaaaaaaaaagttccctgatanaanagcatggggtgctctggggaaatattggagggtcatccattccacattaaaagagcaagttgtcca

SEQ ID NO: 438420 - DNA, 1490 bp, Homo sapiens
ctgcccctgggcatccctcccggtctcttcctgcgggtttctgatgaaacagccaggctccagtagtggagccagaggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438421 - DNA, 1578 bp, Homo sapiens
cccagatcttattctacatgcagtggaaacttgtatgacttaagctttttggaaaagcagaaccttttttcgtggttcaagaaatcaaagtcttcccgggaggtctttctgtaaatccagagctgcagatgtttgaccgtgttcagagaggggcccttgtgctgggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438422 - DNA, 1178 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggccacattttcctagagcgagaattgggggaaagctgttatttttatattaaaatacattcagatgta

SEQ ID NO: 438423 - DNA, 551 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggtaaggaagccataaggaagccacccaccggcgggtggagcctggagctcggtcgtgggcgtgatgtcccgctccacctgtggggccttagcatcctccctcccctcgctgacctttgacctccacgccgggacccagagttggggtggactagccagggccagatgtggggta

SEQ ID NO: 438424 - DNA, 498 bp, Homo sapiens
cagccctttagagcgcctggcacagggcttcctagcagattgttgacatttctggctccactgcccaatatcaggcccaagatcgggtgggcaggttccacgtcctctctgtccttgggttgcagcgcccagcaggaggcagcaatggagaactgggtgcaggagggacaggcccacccaggctcatgcctggacttggccttggctgccctccagctcccctacccgacacccgtcaacccggtctagattccattccagagaatgagcattcagctgttctcccaacccaccctccagcccgcatcgctgcctgcccccagggaagggaacccacagggaatggggatctcccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438425 - DNA, 198 bp, Homo sapiens
cggcgaattcgtggtgctgctcggcgaattcgtggtgctgctcggcgaattcgtggtgctgctcttctttgttgctgtcggtcctggaaagccactggttcgtgtggatcacacagatgaaccacatccccaaggagatcggccacgagaagcaccgggactgggtcagctctcaggtgggcagcaggggtggggccc

SEQ ID NO: 438426 - DNA, 2201 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagaggtatggcagggagtggcgaggtcacacacaggcgacaggtgacccccactgcagccccccaccagagcttcccttttcccgtctgcagaatggggccagtggtactgcctccctggcttgctggtggaatcacataaacacaagcgtggcaggagcccagggtcggtgggtttagggagcgtggcctggcttgtaagtggcccggtgggtgtcggagctgctctggactcagcctcacagtggacactgctccattcagattctttaaacactggcaagggggcgatggccacaatcctattgtacagataaggaagtcaaggccacttggggacagctgctctccagcctccactcagggtgcctaagtggtgagctggacctagggcagtgcccgagcctccccacaggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438427 - DNA, 1817 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccagtgccagcatacgctccccacccccagcctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438428 - DNA, 1646 bp, Homo sapiens
cccagcagagggctccgagagagctgcagcggcggtgggggccccgcagagattggggcccatggtttgaaggctgttcacaggcaccccgagacagcgtcccccctctgggcgcactggatttgacgttgcaggacgcgcggctggaagccccccaggccccgctgctcacagaccgggactccgcctccggttcccgagggcgtggcgaggcgctgcgggacgcccaacaggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcggatttgctctgggccgccagcttctatgcccgcttcttcttatcctacctccccttctacggcgtccctggggtgctgctcttctttgttgctgtcagggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438429 - DNA, 1337 bp, Homo sapiens
ctgactgtctgctctccttcaggatgccttccgtgccttccatcaagatctcaattttgtgcgcaagttcctacagcccctgttgattggagagctggctccggaagaacccagccaggatggacccctgaatgcgcagctggtcgaggacttccgagccctgcaccaggcagccgaggacatgaagctgtttgatgccagtcccaccttctttgctttcctactgggccacatcctggccatggaggtgctggcctggctccttatctacctcctgggtcctggctgggtgcccagtgccctggccgccttcatcctggccatctctcaggctcagtcctggtgtctgcagcatgacctgggccatgcctccatcttcaagaagtcctggtggaaccacgtggcccagaagttcgtgatggggcagctaaagggcttctccgcccactggtggaacttccgccacttccagcaccacgccaagcccaacatcttccacaaagacccagacgtgacggtggcgcccgtcttcctcctgggggagtcatccgtcgagtatggcaagaagaaacgcagatacctaccctacaaccagcagcacctgtacttcttcctgatcggcccgccgctgctcaccctggtgaactttgaagtggaaaatctggcgtacatgctggtgtgcatgcagtgggcgggtcctggaaagccactggttcgtgtggatcacacagatgaaccacatccccaaggagatcggccacgagaagcaccgggactgggtcagctctcagctggcagccacctgcaacgtggagccctcacttttcaccaactggttcagcgggcacctcaacttccagatcgagcaccacctcttccccaggatgccgagacacaactacagccgggtggccccgctggtcaagtcgctgtgtgccaagcacggcctcagctacgaagtgaagcccttcctcaccgcgctggtggacatcgtcaggtccctgaagaagtctggtgacatctggctggacgcctacctccatcagtgaaggcaacacccaggcgggcagagaagggctcagggcaccagcaaccaagccagcccccggcgggatcgatacccccacccctccactggccagcctgggggtgccctgcctgccctcctggtactgttgtcttcccctcggccccctcacatgtgtattcagcagccctatggccttggctctgggcctgatgggacaggggtagagggaaggtgagcatagcacattttcctagagcgagaattgggggaaagctgttatttttatattaaaatacattcagatgta

SEQ ID NO: 438430 - DNA, 599 bp, Homo sapiens
gagccgggaggcgcacgctcgctcgtacggcggccgcggcggcagggcggggccggagcagcgggcggcggcggaggcggcgcccgggagcgctcttcgcttccctcggggtcttgctcggacctcggccaccgcctgggatccccaggactcgtgcgtgcagcatgggcggcgtcggggagccgggaccgcgggagggacccgcgcagccgggggcaccgctgcccaccttctgctgggagcagatccgcgcgcacgaccagcccggcgacaagtggctggtcatcgagcgccgcgtctacgacatcagccgctgggcacagcggcacccagggggcagccgcctcatcggccaccacggcgctgaggacgccacggttggccacactgggtatcaggaaggtcttcaagacccgaggacatgaatcctgaatgctggctttttgggcagcagcggaggttctgtccagtcccaggactgtcggcgtccctcttgccagggccacctgctctctgccgattgccatctccagcatgttggacaatcttcactggactctttgaggaagaaagcccctcttttccctttccaccccatg

SEQ ID NO: 438431 - DNA, 749 bp, Homo sapiens
ggatttattttaaattattaatatttttgctaaaaggaagtaccagctcacctgttcctagagcaatgtcttcccagcagcagcagcggcagcagcagcagtgcccaccccagagggcccagcagcagcaagtgaagcagccttgtcagccaccccctgttaaatgtcaagagacatgtgcacccaaaaccaaggatccatgtgctccccaggtcaagaagcaatgcccaccgaaaggcaccatcattccagcccagcagaagtgtccctcagcccagcaagcctccaagagtaaacagaagtaaggatggactggatattaccatcatccaccatcctggctaccagatggaaccttctcttcttccttctcctcttccctccagctcttgagcctaccctcctctcacatctcctcctgcccaagatgtaaggaagcattgtaaggatttcttcccatcgtacccttccccacacataccaccttggcttcttctatatcccaccccgatgctctcccaggtgggtgtgagagagacctcattctctgcaggctccagcgtggccacagctaaggcccatccatttcccaaagtgaggaaagtgtctgggcttcttctggggttccaccctgacaagtagggtcacagaggctggtgcacagtttctgcctcattcctctccatgatgccccctgctctgggcttctctcctgttttccccaataaatatgtgcctcatgtaataaa

SEQ ID NO: 438432 - DNA, 252 bp, Homo sapiens
cttctcatggtgtccctgcccggtttcctttaggctcacctgttcctagagcaatgtcttcccagcagcagcagcggcagcagcagcagtgcccaccccagagggcccagcagcagcaagtgaagcagccttgtcagccaccccctgttaaatgtcaagagacatgtgcacccaaaaccaaggatccatgtgctccccaggtcaagaagcaatgcccaccgaaaggcaccatcattccagcccagcagaagt

SEQ ID NO: 438433 - DNA, 2425 bp, Homo sapiens
accgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaat

SEQ ID NO: 438434 - DNA, 1040 bp, Homo sapiens
gatttttgcctggacgaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgaggtaaggaattcttacattttaagttttgcattgttaggattgttaatggtatagatttttttccccatctgaaaggaagatggtaataaaggagaaaccctttaaaagttctgatatttatttgtatttccaggattttcatggggcagtgagttaatactatatattcttctgattatttcttcatgctctgtacttctgacatttgtagactcctggcgggtgcagggaggggcatttttcatatttccttctttgtaaaattaattttgtaaacttttatgcatttcataaagggatttgattaccatcatgttctatttacacttttggttggtttggtaaatatataggcttgaatgtagtctttaagaatattagattttttgagggagggttccttgaccagtatgttgctgtgttgtaggaagagagtgcttatacttttttcaaatatcattacacgcatagaaataaaattttgctcatttttgagaggaacatatttggagtgccagattacctttggaataatctttaagaatttccttcagcctgctgacaagttcagttttcattattgttgttgagtacagatttaaaaatttacccttaagatatg

SEQ ID NO: 438435 - DNA, 527 bp, Homo sapiens
gctattagaagtggcgtttgcagctaagtacagtgagagcagcaagcttaatctgtcatgcaaacaaaagtaaaaatgctctctgattgcttcagtcacatcctaactacattaaatttcctgccagcaggcaccccattcattctcctacaaacctaatggaaccaaaatggctttttcctctgatttctttagttttcaaaaatagataggcagtagatctttgggggaagtgaaacttcaaggatttttatataatatatctccttggtgtttcttcttaagatagtatctttcataccacctcatccggttttaaaaaataagttgagcagaaacaaagtcctcataaaattccaggtatcattatgtgaaatggcttctcttatgctctggaagaagctgcttggtgtgccttttagcggatgggaaatgggatactaatctttaaatgagagataacatatatggcataatcacattcatgagactagacctacgatcgcaatctgggagtcttgtctagt

SEQ ID NO: 438436 - DNA, 4294 bp, Homo sapiens
tgcctgtggggacgctggctggtgctctcaaaggaggactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggtttt

SEQ ID NO: 438437 - DNA, 3527 bp, Homo sapiens
tcggtacccccccgactagcccgacagccccgactagcccgacagccccgactagcccgacagccccgactagcccgacagccccgactagcccgacagccccgactagcccgacagtggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggtttt

SEQ ID NO: 438438 - DNA, 2214 bp, Homo sapiens
gatttttgcctggacgaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaatttacatat

SEQ ID NO: 438439 - DNA, 2300 bp, Homo sapiens
gatttttgcctggacgaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggtaagactacacagttttgtgttcctaatcaatatttctttgctttcatttattgaaaaatttttattatgaggtattgtatacaaaagggtctataaactgtatttgtatagtttttgtaataatagaacaaacatctgttacctgtcccctggctgaagaagatgataacctgacctgtagaaacccctgagtaccccatcccatctcatctgccttgctcttcatataccccatcctcaggtggaggagtcttgaattgtacattaattattcccttgattctctttatttttgtcacccatatatagatatatcaataaataatatgtgttcagttttgtttgtttgctattttgttatttagcattccgttgaaatattcattccataattgatggttatttgggttatatcctgtgtcttttctat

SEQ ID NO: 438440 - DNA, 558 bp, Homo sapiens
tctactttcatgctgcaacagcagagttcaatagttgtggcagaggtggtatggctagcaaatcctaacatatttactgtccagcaatttgcagaaacagtttgctgtgacccctgttctagtagagatgctgcaggcaatcttggaagagttggtagtttaccagggatcaggttttgtgaatttcccatggcagtaattttcccaggaaactcttcacatttcctttgagcagcttgacctcacatgtgagaaacacaactgtagatgacttatgtgatgaaaggcatcagatatcaaaatcaccaactaactagactagttagaatacctagtgtgattttttggctaatgtgctttttgagtttttctccctttgttttttctcctcttttcctgccctgcccctgtatccctccctgacttaaacaggtttgaattcctcagcaacatctacagcaaataatagccgttgcgagggggaactccgcctcggagagagagtgttagtggtaggacagagactgggcaccattaggttctttgggacaacaaact

SEQ ID NO: 438441 - DNA, 691 bp, Homo sapiens
ctgctctgcaattatgcttgtaaaatgtttttcctgttcactttttgaattttcaaagtttacaattttataatttgaaatcttaatgagtatcatgatcttccctcattttggtcatttatggaaatgttaaaacacctcgactttggttttgtatagtagcataagagttttggataaagtacagatgcttttgaaatgcaatattcatgttctaggatattggtatggtatagagcttgaaaaaccccatggcaagaatgatggttcagttggaggtgtgcagtattttagctgttctccaagatatggaatatttgctcccccatccagggtgcaaaggtgagagaatgaaatttatgtttatttacagaaactttttgtaatctgcagtggttaatagagacactaattttatattaaagatatgctctgattgtagctcatgtcttctttcaaggggttaaccaaccaccttcttcagagagaaggctcatggaaagctaaatttgctttgctgaggatttgcaattttaaaaacctcctttattcctcatttgcaaaccctatgagtatgtgtaggctattagaagtggcgtttgcagctaagtacagtgagagcagcaagcttaatctgtcatgcaaacaaaagtaaaaatgctctctgattgcttcagtcacatcctaacta

SEQ ID NO: 438442 - DNA, 4174 bp, Homo sapiens
gatttttgcctggacgaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggtttt

SEQ ID NO: 438443 - DNA, 4289 bp, Homo sapiens
accgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggtttt

SEQ ID NO: 438444 - DNA, 2140 bp, Homo sapiens
gatttttgcctggacgaccattttgttgtctaagcttacgaatgttatcacatttcagttcaatctttctgattctcttctgatggactgctgctctgcttgtatatgtgtctttagtttggtgcctctcatcttttagttatgctgactctagaagtaagaactatgtgtacatagtataattttggaaaatatataaatgcaaagaagaaagcaaaaacaaaaaaacctcaatgagtcccactacttatgcatgctgttacaatctgagctcagtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgacta

SEQ ID NO: 438445 - DNA, 776 bp, Homo sapiens
tgcctgtggggacgctggctggtgctctcaaaggaggactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattgtctgatgtggtggtgctgaagctactggtggtgatggactcctttttcccctcacaactcatcatgaactgatactttcacaaaataaaataaaaatgaatttataatacaaaataaaataaagccataaaatataagcccaaa

SEQ ID NO: 438446 - DNA, 517 bp, Homo sapiens
agcagcaagattaagaaaattgtgcattcaattatatcatcctttgcatttggactatttggagttttcctggtcttactggatgtcactctcgtccttgccgacctaattttcactgacagcaaactttatattccttcggagtatcgttctatttctctagctattgccttattttttctcatggatgttcttcttcgagtatttgtagaagggtaagtttgattatttttataatgcattaagctattttgtacttttataagaagcactttgggaggctgaggtgggaggatcccaaggtcaggagttcgagacaatcctggccaacatggtgaaaccccgtctctactaaaaatacaaaaattagctgggtgtggtggtggttgcctataatcccagctgcttgggatgctgaggcaggagaatcttttgaacctgggaggcagaagttgcattgagccgagatcatgccattgcactctagcctgggtgacagggtgagactccatctcca

SEQ ID NO: 438447 - DNA, 2146 bp, Homo sapiens
  misc_feature (1188)..(1188): n is a, c, g, or t
  misc_feature (1428)..(1428): n is a, c, g, or t
  misc_feature (1490)..(1490): n is a, c, g, or t
tgtgggcgcgacggctgcgagttggggaggtctgtggtgcgggtcgccccgggggatccccggcgcgggcctcgcgcgacggtccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactatttggagttttcctggtcttactggatgtcactctcgtccttgccgacctaattttcactgacagcaaactttatattccttcggagtatcgttctatttctctagctattgccttattttttctcatggatgttcttcttcgagtatttgtagaagctcatccacaccgctcagcacgaaggccttgttctcaggggcctgcttctcaatgaggcggatctgcttgaggttggcatggggcccaatgccaaccgggatcacgatgaccttcttcttcttcaggccctggacgtagcggacaaagttccgggacatccgttggggctcctggctggccatcaggagcagggcgatgcggaaggcttcagggcggtcgatcttgctgatgatttggaacagtgtgtatttcaaggcctcgctggtggaggccacctggctgcccgcatacttcaccnggctggcaacgcgccgcagctctgacggtcgcttccggtccttgagcccgatgtaggcgtgggagccgtcgtggtactccaccacagccacgcggacccacttctaggagatgcgcagccgctccatcatgtccaccacaaaggccttcagcacttcaaactcagcctcggacagcctggaggagccatccagcaggaagatcaggtccagtagcctgctgcagtagaaatcgtgcaacngcggttctgagatgtcctccacatacagagtggtggggctcaccggggcatctgtgggaggnaccaccaggcctcccggctcctggcaggcttcacaggtgagggtgacaccatcacagtggctgcagaaaagagcgaagaaattaaaatggttcagaaagaacctatggacacttctgagccctacagtgtatgactacttccatattcccacagaatctcctctgttccacctgaacttgagatcccacggaccattccacacccaagtgagatgtcactgtttaacatctgtccccaaatagcatgcccccccacttcaaaacacacacatagccgacttcctttgattctagaaaccaaagctttagcccatcctaggatatgaaaaaatatactcgttgttctaggccatccacacagccactcaaagctgatttcttttcaacctacatctttagcaacatgaatacttaattataatctaagccttcttacaagtgtctccaagaacaaatgttactaaaatgtagacgctaacctgtgcttgtacatgttctgttgaagataaatgctttacagtacatattctaacagaatgtaaattgcatgagttttaaaacatgtttaatacgttgggccctaacgaagagagaaaaaattggagcaaaaacattgtggaaagatgaataaagattcaaaaccccagctttatcta

SEQ ID NO: 438448 - DNA, 1201 bp, Homo sapiens
tgtgggcgcgacggctgcgagttggggaggtctgtggtgcgggtcgccccgggggatccccggcgcgggcctcgcgcgacggtccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactatttggagttttcctggtcttactggatgtcactctcgtccttgccgacctaattttcactgacagcaaactttatattccttcggagtatcgttctatttctctagctattgccttattttttctcatggatgttcttcttcgagtatttgtagaagggaacaacactacagtcgcccgtagttttgtttctgttcagtctccattgtggcatgccacactctcctggtttgggccctgctcatttctttactgccttcctgcctgccctttttgtgcaggtggattcttgctctgtcacccaggctggagcgtaatggcacaatcttcgctcacttcaacctctgccttctgggttcgagcatcccagctactcgggaggccgaggcaggagcattgcttgtacccaggaggcagagattgcagtgagctgagatcacgccattgcactccagtctgagcaacaagag

SEQ ID NO: 438449 - DNA, 359 bp, Homo sapiens
tcgctcacttcaacctctgccttctgggttcgagcaattctcctgcctcagcctcctgagtaactgggattacaggcgtgtaccaccacatctggctaatttttgtatttttagtagggacggtgttttaccatattggccaggctggtcttgagctcctgaactcaagtgatccactcgcctcagcctcccaaagtgctgagattacaggcttgagcaaccttgcccagccaaaagtaaactttttaattccatcacaatatgttctagatctttgacagactgaaagacatagaatgtcaaaaggtgagactctctcatgtggctaaacaccctcctactgcagatacagaactgag

SEQ ID NO: 438450 - DNA, 1992 bp, Homo sapiens
  misc_feature (1650)..(1650): n is a, c, g, or t
tgtgggcgcgacggctgcgagttggggaggtctgtggtgcgggtcgccccgggggatccccggcgcgggcctcgcgcgacggtccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactcagcccacctgcacccaggtgaaataaacagctttattgctcacacgaagcctgtttggtggtctcttcacacggatgcgcatgaaatttggtgccgtgacttggatcgggggacctcccttaggagatcaatcccctgtcctcctgctctttgctccgtgagaaagatccacctacgacctcaggtcctcagaccgaccagcccaagaaacatctcaccaatttcaaatctgatctattcggcttagcgactgaagattgacgctgcccaatcgcctcggaagtcccctggaccatcacagaagccgagcttcgggtaactctcacagtggagggtaagtccatcccctgtttaatcgatacgggggctacccactccacgttgccttcttttcaagggcctgtttcccttgcccccataactgttgtgggtattgacggccaagcttcaaaacccctgaaaactcccccactctggtgccaacttggacaacactcttttatgcactcttttttagttatccccacctgcccacttcccttattaggccgaaatattttaaccaaattatctgcttccctgactattcctggagtacagctacatctcattgctgcccttcttcccaatccaaagcctcctttgtgtcctctaacatccccacaatatcaccccttaccacaagacctcccttcagcttaatctctcccactctaggttcccacgccgcccctaatcccacttgaagcagccctgagaaacatcgcccattctctctccataccaccccccaaaaattttcgccgctccaacacttcaacactattttgttttatttgtcttattaatatcagaaggcaggaatgtcaggcctctgagcccaggccaggccatcgcatcccctgtgacttgcacgtntacatccagatggcctgaagtaactgaagatccacaaaagaagtaaaaacagccttaactgatgacattccaccattgtgatttgttcctgccccaccctaactgatcaatgtactttgtaatctcccccacccttaagaaggttctttgtaattctccccacccttgagaatgtactttgtgagatccacccctgcccaccagagaacaaccccctttgattgtaattttttattaccttcccaaatcctataaaacagccccacccctatcttccttcactgactctcttttcggactcagcccaccggcacccaggtgaaataaacagctttattgctc

SEQ ID NO: 438451 - DNA, 1192 bp, Homo sapiens
tgtgggcgcgacggctgcgagttggggaggtctgtggtgcgggtcgccccgggggatccccggcgcgggcctcgcgcgacggtccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaaactatttggagttttcctggtcttactggatgtcactctcgtccttgccgacctaattttcactgacagcaaactttatattccttcggagtatcgttctatttctctagctattgccttattttttctcatggatgttcttcttcgagtatttgtagaagggtaagtttgattatttttataatgcattaagctattttgtacttttataagaagcactttgggaggctgaggtgggaggatcccaaggtcaggagttcgagacaatcctggccaacatggtgaaaccccgtctctactaaaaatacaaaaattagctgggtgtggtggtggttgcctataatcccagctgcttgggatgctgaggcaggagaatcttttgaacctgggaggcagaagttgcattgagccgagatcatgccattgcactctagcctgggtgacagggtgagactccatctcca

SEQ ID NO: 438452 - DNA, 800 bp, Homo sapiens
ccctcgcccagccctcccacctgcacacaaggtgccagcataccaggggcaggggagcgggtggggatctgcagcccctctccggagcagcacctctgcagcaccaggtcaggagcctctcaggggagcgtctcaaagtcctggatgaggatgggggcattgggccagccgatcctctccagctcctgaacgttggcattagggcccactccaatgggcaccacctggatgtctccaggcaacctcttgatcttatcagaggcaggatttctggtgaccatggagaccaggttgggcacctgctcccggtcaccctggctgaccaagaagctgtggtcggaggggtacagcagggccaccccagtgttggtcctgttgccaccctggtagcggatctctcgcacccgctgcaggatgtcccctttggactgtgcctcgctgaaggggtactccacggtcaccatgtaggagtactgcagcaccgtgacgtggatgctgtcctggcccacatccatccgctgaatcacctcctccatgaactccttgctcctgttgaagttggcttcaccaattttgtccgatccttccaggacaaatgccacatccagaaccatggagttcctcttgggccccagggtcgaaagccccaagagccccgggcccacagtgacttgtgccatgtgggggggcagagtaggaggaggggcgtcaggggcaaggtcacagaggtagctaacgatctcttccctttgctgctccagctcatccacaccgctcagcacgaaggccttgttctcagg

SEQ ID NO: 438453 - DNA, 406 bp, Homo sapiens
attgtactccagtctgaaaacagcaagaccccgtctctaaaaaattaaaaaaaatatacaacataaacctaaactataaaacagcaatggttccaggtaatgttggccgtgacatttaaagaacaaaattgcttatgaagttgagatggttgccaaattgtaaattcctaactcagggctttgaaaaatcaattgtaggaaagaatctttgacaatttggctacagaaaaaaggaatgattcttttaaaattgtatgcagatggattcactgaaatgcaaaggttgtaataaaacaatttttaaatgttggatcaacagatagtgtaacaaagcaccttgaaacagtattcaccaaataataaaaagctcaactttttattgataaataaaattcgatctaaaata

SEQ ID NO: 438454 - DNA, 1246 bp, Homo sapiens
gtaaaatagagcagattcttaatatattttaaagatagaaccaacagaattttatgatagattagatctagtgtttgaaagaaacgactcaaaggttttggcctgaaaaactggaaggatggagttactatcaactgaagtgagaaagttctgtggggaactggtttgtggggactcctgactggcattcaggagtttaaatttggaaatgttcagtttgagatatctatgagacagccaacttaagatgttgaggtgactgttggatatttgaatccagagtttgggaaagaggtctgtaatatcccttggtatgtgttaaaatccttaggccagtacatacagttcacttatttaatcagattgttaagataatagttttctccttatcctatatgtagagccaatacaatttatttttcaccttaggagttagaaaagaggaacaaattcaaccccaaataagtaggaaataagaaatttcatgaaatagggaaacaaacaatgggagaaattttaaaagtgaaaagttggccttttgaaaaggtaaataaattgataaaccccaagcaagacttaccaagtgtattagcctgttctcacactgttgtaaagaactacctgagactgggtaatttatgaagaaaagagatttaattgactcacaggcccacaggcttaacaggaagcatgactgggagtcctcagtaaacttacagtcatggcagaaggtgaagggcaagcaagcacctttttcacatgatggcaggagagagagtgacaatgaggggggaaatgccacacatgtttaaaccatcagatctcatgagaactcactatcacaagaacagcaagggggaaattggcccctgtgatccaatggtcccccaccaaacccctcccccaattcaacatgagatttgggcaaggatgcaaatccaaactatatcacccaagaaaaaaagtgaaaacataaattatcccacatcacaaatgaaaagagggcatcagtttagaccctacatatattaaaagtaaagtgggtatggaaaacttcattgacaagccgcaacttgatgaaattgacaaatactttaaaagacacagtttaccaaaactgacacaagaagaaatagaaaatcttaaggaactccatatctactacagagattgaatttgtaataaaaaattttctaacaaaaaaactctaggcccatagtagcagtaaattttatcaaccattcaa

SEQ ID NO: 438455 - DNA, 5714 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacgactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagta

SEQ ID NO: 438456 - DNA, 392 bp, Homo sapiens
tggcccgctctgcactcagatgtcctgataagtgagcatttctaagcctcgattgcttactggaactattgtgtgcaaatatgaaagcttacatatgcttaacgtaaaaccatacctttgtcactggtgaatcactgggagtaaaactaacacctatggagtaattgttcgttgctaggcgcctgtatgctcagatgtcatcacttttggtctgtgctccagccctgtgggatggttgttattcgaggtcagaagggaagcagagacttggcttcaagagagtgaaccttgaattcactggatggagcttatttggtctgatcagagatttagacgacaggagcttttcccaggtcagaacgcctttagcatgtgcagcagctttgcctcca

SEQ ID NO: 438457 - DNA, 4083 bp, Homo sapiens
tggcccgctctgcactcagatgtcctgataagtgagcatttctaagcctcgattgcttactggaactattgtgtgcaaatatgaaagcttacatatgcttaacgtaaaaccatacctttgtcactggtgaatcactgggagtaaaactaacacctatggagtaattgttcgttgctaggcgcctgtatgctcagatgtcatcacttttggtctgtgctccagccctgtgggatggttgttattcgaggtcagaagggaagcagagacttggcttcaagagagtgaaccttgaattcactggatggagcttatttggtctgatcagagcttagagacttcacagtcccctatctgtgttgacaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacgactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagta

SEQ ID NO: 438458 - DNA, 4982 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttcgcccgtagtcagtgagatcctgtagagtgacctcg

SEQ ID NO: 438459 - DNA, 4598 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatgagacctccgtacgaagcaaggactcactgcctgtc

SEQ ID NO: 438460 - DNA, 822 bp, Homo sapiens
tggcccgctctgcactcagatgtcctgataagtgagcatttctaagcctcgattgcttactggaactattgtgtgcaaatatgaaagcttacatatgcttaacgtaaaaccatacctttgtcactggtgaatcactgggagtaaaactaacacctatggagtaattgttcgttgctaggcgcctgtatgctcagatgtcatcacttttggtctgtgctccagccctgtgggatggttgttattcgaggtcagaagggaagcagagacttggcttcaagagagtgaaccttgaattcactggatggagcttatttggtctgatcagagcttagagacttcacagtcccctatctgtgttgacaggagcagaacccttccagtgtccctgtgcaagcccaggctaccagtgttgggacccagccgcctgccgtgtccgtggccagctcccacaacagctccccctatctcagcaccacgactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagta

SEQ ID NO: 438461 - DNA, 2803 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggtaagtatgagcctttgctttctgttcctctgctgcagacacttcagtgaggttactcactactttggatgttaattggatccgaggtagttgtgggaagagggaggagggaatagctgctgtcatccttgctcctcttgggagtggaaatttataaaataaaccagggttgattgttaataaaaaatagggtaaagttccctggcatagcttgattattaactgcatgaaggtttcaggaatcacctgcatttagtccactgtctctttcgtgccgtaggatttaaattaagtaatttgcgactgtgttttgcagataaacattacgtttcacgtgcttcttagaggcttggcttttttttttttttttttactacctttcagatctccatgtacaaaattccctaatttttggtaagcttataacattgtaggcatgtgctgcttcccagcacagctcagctctgtgcttacttcatcatggttctaaagcccggtagcatcaaatggaaaatggcccttcgggttgtttcctgttttccgctagtgcagataagcctgcagtgaacgtgaatttgtaatacatgctaaaattttgcaaattaaaaagcccagtgccggtaatatcatgaggaaatagacacactcctgtattgatgagagtgtgtaaatgagctcactgcttttgggaagtcatttgacattatgtatttttcacatgctgtaaaatgttcatatgcattgacacactatatacccgacaagttgatctaaagaaataatccaaaatgaaagaaaaagttatatcc

SEQ ID NO: 438462 - DNA, 2403 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacaggtagggggtgtctgtgtgacgagcagggacaggggaggccgctgcctggtgctggttgaatccctgctgtct

SEQ ID NO: 438463 - DNA, 4123 bp, Homo sapiens
gtgcctagaggatcccctgaatcgacggtttctcatcagaaaccaacatcttcaatttcaggttgtcttccgactctttctcttctttttctttttcttcttcttgtcttcctaactccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacgactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagta

SEQ ID NO: 438464 - DNA, 5954 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccagtttccacatgcagcagcaggcccacctgaaaatgtctagcccgcaattctcccaggcagtgcccaacaggcccatggctcccatgagctcagcagctgccgtggggtccttgctacccccagtgagtgcacagcagaggaccagcgcccctgccccagcaccacccccaacagcccctcagcagggcttgcctggcctgagcccagcagggcctgagctgggggccttcagccagagccctgcctcacagatgggcggtcgggcggggctgcactgcacccaggcctaccctgtgcggaccgcgggccaggagctgccttttgcctatagcgggcagccaggtggcagtgggctctctagtgtggctggacacaccgatctgatcgactccctgctgaagaacaggacttcagaggagtggatgagtgatttggacgacctgttagggtctcagtaatggaaggatttgtagtgtttttagtgttcattcatcctatatttttattctcagattcaaagaaagagcaactactttggaccaaaagcccatggcctggggagctgggcaggtagagcccaagctccaggtgaggcctggccctgggcagggtctgtggctgcgcccctcaggccagcagttgaggtccatcgggctggccccagcccatctgctggcatcagtacctggtgttgggacagcaggatagggttctaaaggtggttttctatccaaacgaccaaaaaaccaacagtaacaccagtgaaaccccacactgtcgggcttataaaaatctgtgccatcatggtgattttatccaagactgctccacttaccccagtgctggggacaagtttctgttgaaactttagatagcagaattatttgcaatttgtagcatagaaaagatttttaaatttttttacaaaaggtttttaaacagattagggtaggtgatggtttaaatcaattaagtggcattggaaacctagggtttccttttgattaagagccttttttgtttctgctctttgtcagctttcaggggagaaggaggccactggaaaattatttccctaagtgcaggctgttgactgcgtatgccaaaaagggacaggaggcatgggatagcaggtctggtgacacagctagggtcttcctagcagctcctcctcctccctcccaaggcccccaggaatcccttcctcccatgtcctggcagcaggaccccaggctacatatggaaggtagagatgtgggggtcctgtatcctggagtattatgtctccccaccttctgcagttttctctgaacatgtatgttgcccatggtgggagcgtggtcactgtgcagttgtgcacagatgtctttcctttaccgttggcctttctgtctgcctctccttcctctctgcagcccaaatggaaaacaattatttactccattggagggaaaggaagagtcttagaattcctaagggaaccttagcataaaggttttggggaaggaggccgtaggccggcccggaggaagcaattccacttggtttgacaacttctgccactcccatgtcagatgacttgcacttcttaaagagattgctttataacactaagacatcctttctaaagattcaagtggacttgactaagctgagggtccacgaaatagaatatgacatgtgagctgtttttggaaaacgaagatggagagagcacttccccgtaacgaaagcaaagtggtaagcacagggtgagacccttttacacagaatggtggagagaaaagagaatgctgaaaagtggctcagatgcagagtgttctgtggagaaactgcagccccacttctgtttccctggagtctcccaatggatcattcaggagtgtcctatgtgagaattgagccaaggaaaatactcatgcaaccagcctgagtcgcggtgaggggacgagaggttgtacacacattggtagttattttgcaccagcagtgcctttctcactgggggtacttggaccctcagatcttcttttctaatagccatttgccaccccaagtggtatgtcggccatttctccttaaaacaccttccctacctttcccatgtactcagtttagctctcaaagaaggggtgaatcataaagccagtgaaaatttcaccctctgagggagttccccaatctgaaggggaagagggtgacctcagcggcttttctcccaaaaatcggctgaaggctggttgtggatccttgttcctctcctgaccccatctggctgctgccccgtctcccacccctgtccccggggctcgctggccctgcactccgccttagtcctggggccggcgacacagtgggggctcctcacttgctgcagtgtcatagcaataaaatgtgattcttggggtccccccagggagctgcccatggctttatttatgaacctggttttcgggagtcaggggaggagatgactttgcttctgtgcacagccccgtcttccaggagccacgactcagaagaaaagggtgctcagacttttgttatacacatttgctttgtgtaaataaatgtttacaattttatatgaaagatggaataagcgctagagcttccaactgtatattttttacttttatagattttaaaactatgatcctttatatgtgtgttttgggggagctatgataagttttatggcaaacggttggtattgttaactttttattgtcatcaaaagttcataaaagtcctattaatccccatattcttctactgcccttaactctggtatacaccaaaaagaaatctttactttccttgttttatcattataaaaataaagtattttgctagtaaaaaaccaacaaaaaccacaacaccccaacaacacaaaaaaaccaatcaaccaaacaccacaccatacaccaacaaacataaaaaactacacacaacaaccctatcaccaccgacaactcaacacaccaacacccatccatcaaacaaccacacaccaaaaggaccactacccacaccccccacccccccacacacccactcacccacacctcctctcactcaccccacacacactaccc

SEQ ID NO: 438465 - DNA, 2956 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagggtcctctgctgccgtgcccggcatgaacaccttgggtccatccaactccagctgtcctcgagtgttccctcaggctgggaatctgatgccaatgggccctggacatgcttcagtttcctctctccccacaaactcaggccaacaggaccggggtgtggctcagttccctggctcccaaaacatgcctcagagcagcctctatggcatggcttctggcataacccagatagttgcccagcccccgccacaggccaccaatggacatgcccacattccacggcagaccaacgtgggccagaacacctccgtctcagctgcctatgggcagaactctctgggaagctctggcctctcccagcagcacaataaggggaccctgaaccctggtttaacaaagccaccggtcccaagggtgtcaccagccatgggaggccagaattcctcctggcagcatcagggaatgccgaacctcagtggccagaccccagggaacagcaacgtgagtcccttcactgcagcctccgggccattcaacgcctccgggccattcaacgcctccgggccattcaacgcctccaggccatcacgcctccgggccattacaacgcctgggatccttagaaa

SEQ ID NO: 438466 - DNA, 2443 bp, Homo sapiens
cggccgcggcggtagcgcggaaaacaatggggccggggcggtggggagaggccgaggcttgaggtaggcagcaagcgccggctgggggtcgggccgagcggggcaggaggaaaacccgccgccgcgcgcgagcccgctccgctgccctcgggggcatggcgcggccgtgaggcggagaggggtagccgcggggagcgaagcccgcagtgccagccggccccgagaggcccggccccgggcccggcccgtgcagcccgcggcccatggtgctgcccacctgccccatggcggagttcgcgctgccgcggcacagcgcggtcatggagcgccttcgccggcgcatcgagctgtgccggcgccaccacagcacctgcgaggcccgctacgaggccgtgtcgcccgagcgcctggagctggagcgccaacacaccttcgccctgcaccagcgctgcatccaggccaaggccaagcgcgccgggaagcacaggcagccgcccgccgccacggccccggcgcccgccgccccggccccgcgcctggacgccgctgacggccccgagcacggccgcccggccacgcatcttcatgatacagttaagaggaatcttgacagcgccacttcccctcagaatggcgatcaacagaatggctacggggacctctttcctgggcataagaagactcgccgggaggcccctctgggagttgccatctcttccaatggactgcctccagcctcccccctcggtcagtctgacaagccttctggagccgacgccctgcagtccagtgggaagcactctctggggctagactctctcaacaaaaagcgtctggctgactccagccttcacttgaatggaggcagtaaccccagtgagtcatttcctctgagcctgaataaagaactgaagcaggagcctgtcgaagacctgccttgcatgatcactgggactgtcggctccatatcgcaaagcaacctcatgccagacctcaaccttaacgagcaggagtggaaggagctcatcgaggagctgaacaggtcggtgcccgatgaagacatgaaggacctgtttaatgaggacttcgaggagaagaaggacccagagtcttctggctctgccacacaaacccccttggcacaggacattaatattaagacggaattctctccagcagcctttgagcaagaacagttaggctctccacaagtgagggccgggtctgcagggcagacctttctggggccttcctctgcccctgtgagtacagattcccccagcctagggggctcccaaaccttattccacacctctggtcagccccgggcggacaatcccagtccaaacctgatgccggcatcagcccaggcccagaacgcacaaagagcccttgcaggtgtggtattgcccagtcagggcccaggaggggcctcagagctgtcctctgcccaccagctccagcagatcgctgccaagcagaagcgcgagcagatgctccagaacccacagcaggccaccccggcaccagccccgggccagatgtccacatggcagcagacggggccctcccacagttccttagatgtcccttaccccatggagaagcctgccagcccttccagctacaagcaagacttcactaactccaaactgctcatgatgcctagtgtgaataagagttcccctcggcccggaggcccctacctccagcccagccatgtgaacctgctgagtcaccagccaccgagtaacttgaatcagaactccgcgaataaccaggggtctgtgctggactacggcaatacaaaacccctttctcattacaaagcggactgtgggcaaggcagcccggggtctggccagagcaagccagccctgatggcttatcttccccagcagctgtcccatataagtcacgagcagaactccctgtttctgatgaagccaaagccaggaaatatgcctttccgatcactggttccacctggccaggagcagaacccttccagtgtccctgtgcaagcccaggctaccagtgttgggacccagccgcctgccgtgtccgtggccagctcccacaacagctccccctatctcagcagccagcaacaggccgctgtaatgaagcagcatcagttgcttttggaccaacagaaacaaagggagcagcagcaaaagcatttacagcaacagcagttccttcagaggcaacagcaccttctcgcggaacaggagaagcaacagtttcagcgccatctgacccgcccaccaccccagtaccaagacccgacacaaggcagcttcccacagcaggttggacagttcacagctcagggtctgagttgtgcactgcctatgatccactccacagaagttctgatttcttctctgtgcaatggttctgccggcctttctgccgcccagaggtcctggtgagtggg

SEQ ID NO: 438467 - DNA, 2478 bp, Homo sapiens
ctaactgcggagctttaatcttggccccagtgttcagccactcggaggggcgggggctgtggcccattcaggggctgctggtgggctgtagtggggtgggatgacctggccagagccaacgaggatactggagcccaaagtcaagtttagagaccagctgggaacgtgaatggggctcttgattttcttatcaaaatcaccactcctcccagcttggactaaatattctttctagcaagcagctttgtgagctccctgaagcccaaggaaacccttcggtgggagaaatttcatttctgtctgagaggattaaggcagcaggtgactccccctcctcgcctgccgtgtcctgctattctcaggcagctctaaggagaattcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaggaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaagaagaaaaagaaagaaggaaagaaagaaagagaaaggaaggaaggaaagaaggaaggaaaagaaggaaggaaggaaggaatatagtgttataaatactgcactcaacattttccaaattcttgccattatttttcaaaagtttaatagtttgcagaaatagatactcaagccaaagtctgttttagagaaactttccatggaaagtcagaatttctaccacttccttttctatccacatttccagtgcagaagaaactgagaaacagagctttttgaagagaggacagggccatagcaacaaggaccttcttgggggattaatgggaggtcagtagaattaataaccctccttggatgagtgctactgttttcacatggcttcagatgctatcaacctcaaagaaatgatctcaacagagaagcttattctctcccaacttctacggtaaaatccaggagtattttctctggggatctgcccacaggacaaagtccataaaagcaagtcctgtctggaccatgtggttatctgaagcattagccatcaccagcacaacaaacggggcagggctttccaaggtggggctggtcagaagggaatctttgataagaggcccacaggcagggaaagcgaaatagggttgatgagaccaggggagacctaaaaaaaaggcagctttgtgtcttctagctccaaatatacctgccttttagctcacacactgtcctggagttctcagacctttaggggccctaacacagttcagttcatacaggggttcaaaagggacagtggcccatttgggagacctttaggatcaatgggaatcaattccattgttttgcctcagagtaaagtttctggctcggggacaattataagttgcaaaaaggatagaggcatatcccaagtcttccttcattccacaaataattacaaacaacctactgtgtgccaggcactattcttagcactggaaatacactagtgaagaagcagatgaggaccctgtttattgtttctctccaagaaattctccaagaatattgtttcttggagagaaataataaataaacaagacaatttctgaaagcaataagtgcaatcaagataattaaaggatgctaaagtgtgacttgtggggattgggagagagatgcacagacaatattaaagaggaggcattcgagctttgttgtgaacaccggaagtaacatgccgagcgcctgggggatgggaaactcctatagcaccccacaggctaacagcaagtagggacaagacaaaaagggcaggtggggacatggtagagatgggaccctacccagggaaacagctcccttcagcatctttagccttgccccactcttaggccacacataccccacgtgttgcttcctggagtttcagtgttgccccacatcattccacacacccttcacataggtttcgggcaggagttagggagggccata

SEQ ID NO: 438468 - DNA, 1686 bp, Homo sapiens
gccatttctagggttggaccgtgcaggcacgggcggtcagctgggccgcagctcctccggctctgcagggtcacggaggaagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgctgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcctacgaataaaatatactcagatgtttaaaaaaaaat

SEQ ID NO: 438469 - DNA, 881 bp, Homo sapiens
gccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggaggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatctgaatcaactcaattacatcacagaagaacttagaaacccttacaggtaacagctgaatcagtgcagaggacagtagccgggcagcctgatttctcttctcctggtgaaggctggagctatttccctgggtattccatgatgcccttcccgacagtgaattatttctttttttttttttttgagacagagtcttgctctgttgcctaggctggagtgcagtggtgcaatctcagctcactcatttttgtatttttttagtagagatgagattttgccatgttggccaggctggtcttgaactcccaacctcaagagattcgcccatctcggcctcccaaagtgctgggattacaggtgt

SEQ ID NO: 438470 - DNA, 2007 bp, Homo sapiens
gccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgctgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaagtaagtaccaacagaagggccgcttggcctctgtgaggtgcaggcaggcacggcgtcctcacctgtcctgactccaagacctctgtcacagtgtctcaccctgctggcagatctccctcgtcccaggaggacacatgcccacgccctcactgtacacctctgggtccacccttgattgttttgttcctgtcaattactgtaataagtaggaagggaaagcaccattttcttttctttttggagacacagtcttgctctgttgcccaggctaaagtgcagtggcatggtcatagctcactgcagtcttgaactcccgggctcaagccatcctcccacctgggcctcccaagtagctgggaccacaggcacacactacacctgggcaacagagcgagagtccatctcaaaaaacaca

SEQ ID NO: 438471 - DNA, 437 bp, Homo sapiens
tgaactggaaagtgcagtcgtccctccggacactcctaggaggtttttatttctattcctgcaattctgggagaagacagaagccaggaaagtgtgaaatccaaccagaaggcaggaaagctggccatcctgagcacagggtctaggtgacgcatcaccaaagactgaaaacaatgtcaccctcacccacaacaactccagtgaaactttcgaatttcagtctaactaactgtactcatttttgactcttatttcagagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcctacgaataaaatatactcagatgtttaaaaaaaaat

SEQ ID NO: 438472 - DNA, 1772 bp, Homo sapiens
gccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgctgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcctacgaataaaatatactcagatgtttaaaaaaaaat

SEQ ID NO: 438473 - DNA, 1524 bp, Homo sapiens
ggcaaacaggtgtaaatcaggctggactgaatgtccaacgctggagctcagggccgtccagcgagggcggaccacggtgggcccctccatacgagcgcagcctccggtgggaggaaggctccctggggccggggcagtgcctcacaaggggcctgtgggcccttcctctctgtgttccaggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgctgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccactacaagtttggatgggctcagaaaatctcaaagccgattaccatgcaccttcagatgctaatggaagtggtcccaccggaggaagaccctgagtaacaagctccgtctcttgtagccaagtcagctgaatttattttcttaagcaatatttgtggttatttcttcctttttttcctacgaataaaatatactcagatgtttaaaaaaaaat

SEQ ID NO: 438474 - DNA, 1764 bp, Homo sapiens
gccatttctagggttggaccgtgcaggcacgggcggtcagctgggccgcagctcctccggctctgcagggtcacggaggaagccagctcccctagtccaggccgagcttgcacttgcgtcttgtctgctgctgctgaaccaagatttagctgtgcgccctccttgcagtctcctggaaccagcaggaggaaacatgggggatactggcctgagaaagcggagagaggatgagaagtcgatccagagccaagagcctaagaccaccagtctccaaaaggagctgggcctcatcagtggcatctccatcatcgtgggcaccatcattggctctgggatcttcgtttcccccaagtctgtgctcagcaacacggaagctgtggggccctgcctcatcatatgggcggcttgcggggtcctcgcgacgctgggtgccctgtgctttgcggagcttggcacaatgatcaccaagtcagggggagagtatccctacctgatggaggcctacgggcccatccccgcctacctcttctcctgggccagcctgatcgtcattaagcccacgtccttcgccatcatctgcctcagcttctccgagtatgtgtgtgcgcccttctatgtgggctgcaagcctcctcaaatcgttgtgaaatgcctggccgccgccgccatcttgttcatctcgacagtgaactcactgagcgtgcggctgggaagctacgtccagaacatcttcaccgcggccaagctggtgatcgtggccatcatcatcatcagcgggctggtgctcctggcccaaggaaacacaaagaattttgataattctttcgagggcgcccagctgtctgtgggagccatcagcctggcgttttacaatggactctgggcctatgatggatggaatcaactcaattacatcacagaagaacttagaaacccttacagaaacctgcctttggccattatcatcgggatccccctggtgacggcgtgctacatcctcatgaacgtgtcctacttcaccgtgatgactgccaccgaactcctgcagtcccaggcggtggctgtgacatttggtgaccgtgttctctatcctgcttcttggatcgttccactttttgtggcattttcaaccatcggtgctgctaacgggacctgcttcacagcgggcagactcatttacgtggcgggccgggagggtcacatgctcaaagtgctttcttacatcagcgtcaggcgcctcactccagcccccgccatcatcttttatggtatcatagcaacgatttatatcatccctggtgacataaactcgttagtcaattatttcagctttgctgcatggctgttttatggcctgacgattctaggactcatcgtgatgagatttacaaggaaagagctggaaaggcctatcaaggtgcccgtagtcattcccgtcttgatgacactcatctctgtgtttttggttctggctccaatcatcagcaagcccacctgggagtacctctactgtgtgctgtttatattaagcggccttttattttacttcctgtttgtccacgccagtgcgcctgcgatcaccctctcttttacccttttcccattcaccctcaaatgcgcatgtaagtggtcccctcccccataggcctcagtgacatagcataatatagtagcagcctagtctggtaaaaagtagtatgttcctcaagagtttaggtaatgtcttccattttttctcacgaatgaattaaaaatgattcttta

SEQ ID NO: 438475 - DNA, 7268 bp, Homo sapiens
cggacgcgtgggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggaaaaaaaaaaaacaaacaaaaaacaaaag

SEQ ID NO: 438476 - DNA, 7188 bp, Homo sapiens
cggacgcgtgggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggaaaaaaaaaaaacaaacaaaaaacaaaag

SEQ ID NO: 438477 - DNA, 3279 bp, Homo sapiens
cggacgcgtgggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccggaagtcaattgaagccttgtgcaaatgccctaggggtgtgctgttgggaggcagccccctgtgatgcggaacaccaggctcagattcatcagttcgagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctgaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgttcatcttccccactacccggctaggggctgaaagccagttcagcgatttcctggatgggctgggaccagctcagattgtggggcgacagacactggcaacaccacccatgggagatgtgcacattgccatcatggaccggagtggccagctggaggtggaagtgattgaagctcggggcctgacccccaaaccaggctccaaatccctcccagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatatttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatggaaaaaaaaaaaacaaacaaaaaacaaaag

SEQ ID NO: 438478 - DNA, 2122 bp, Homo sapiens
aggccctcacttccggcggcgcgggaggcgcccagcgagccagagtggtggctggtcccgcgcgaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgcagatacattttgagaaaaaccatcatgttttgaggatacatttgtgaaagtgcaggcatgccaatgactactcagttttaggactttctgtggaagaaaaaattaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatactaaaaaa

SEQ ID NO: 438479 - DNA, 2158 bp, Homo sapiens
gggccgggtcaatgaggagcggccggcggagtgctgggaacgggaggcttggactgggggcccgggcgaggcgcggcccgcggcgggtggaactgggcggaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgcagatacattttgagaaaaaccatcatgttttgaggatacatttgtgaaagtgcaggcatgccaatgactactcagttttaggactttctgtggaagaaaaaattaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatactaaaaaa

SEQ ID NO: 438480 - DNA, 1977 bp, Homo sapiens
gggcattctggcgcggagcgtagcggcggcgggcgcagctagcgggtcggccgcggagcgtgatggtgcacgctcggcttcccaccggcagcaggcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgcagatacattttgagaaaaaccatcatgttttgaggatacatttgtgaaagtgcaggcatgccaatgactactcagttttaggactttctgtggaagaaaaaattaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatactaaaaaa

SEQ ID NO: 438481 - DNA, 434 bp, Homo sapiens
tactttttaaatttaaacatgaatgcaattttggtgggttgaagagatattaaaattgaatagttaacagatatctgtaattttttttctgatcatctctaaattttttttccttctacacacagaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacacc

SEQ ID NO: 438482 - DNA, 339 bp, Homo sapiens
aatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgcagatacattttgagaaaaaccatcatgttttgaggatacatttgtgaaagtgcaggcatgccaatgactactcagttttaggacttt

SEQ ID NO: 438483 - DNA, 2068 bp, Homo sapiens
aggccctcacttccggcggcgcgggaggcgcccagcgagccagagtggtggctggtcccgcgcgaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgactaccctcatttcttttttatgtgacatggagcacaaagaactgaaaatatgttttgagggagcatgacatccttgacctcatttgaaattacttccattttcaaaaaccatcatgttttgcagatacattttgagaaaaaccatcatgttttgaggatacatttgtgaaagtgcaggcatgccaatgactactcagttttaggactttctgtggaagaaaaaattaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatactaaaaaa

SEQ ID NO: 438484 - DNA, 1265 bp, Homo sapiens
ggggtcgaactaggctaggtacgaggcctgggtgttcaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 438485 - DNA, 961 bp, Homo sapiens
caggggacaggctgcagccggtgcagttacacgttttcctccaaggaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 438486 - DNA, 1258 bp, Homo sapiens
aaactacgggctaggtgcgaggctgggtggtgggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 438487 - DNA, 1704 bp, Homo sapiens
  misc_feature (1704)..(1704): n is a, c, g, or t
ggggtcgaactaggctaggtacgaggcctgggtgttcaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccaaaaaaacataacagtctaaacacccgcgagggacttcactactagagggccggcggaaaaactcagcgtacgcgaaatcgggccctggcgctaaacgactgtcctctcgcacccgacttcctcttcaccaccccgtcggtagcctatcgcaccgtcttccccgcttaatggagcgccgcctatattccccgaaacgccccggttcatcccggctgacgccacatcgcgccagccccccgcgccctcacaccccagactccgtcccacacctcctccgtcggcctgcgaacacacaccaccaccacgccgacacctaagcgcagccagcgaccctctgaaccgtgagtacacgcgagcacgatcaccgccgtccccgtcaacccacgacaggcgagacgacagcaccaccccgcgaaccacaccctgcgcttcacccagn

SEQ ID NO: 438488 - DNA, 1068 bp, Homo sapiens
  misc_feature (934)..(934): n is a, c, g, or t
  misc_feature (938)..(939): n is a, c, g, or t
  misc_feature (945)..(945): n is a, c, g, or t
  misc_feature (962)..(962): n is a, c, g, or t
  misc_feature (968)..(968): n is a, c, g, or t
  misc_feature (970)..(970): n is a, c, g, or t
  misc_feature (985)..(985): n is a, c, g, or t
  misc_feature (990)..(990): n is a, c, g, or t
  misc_feature (997)..(997): n is a, c, g, or t
  misc_feature (1002)..(1002): n is a, c, g, or t
  misc_feature (1010)..(1011): n is a, c, g, or t
  misc_feature (1016)..(1016): n is a, c, g, or t
ggggtcgaactaggctaggtacgaggcctgggtgttcaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccntcgnnttgcanggctgggttaaggcacngggccntnggggggtcctggtgncgggnccctctngggtnttgggtcnnccctngtgggggggttgtgcccagtttcggccctttggtgggccggccaaagatttc

SEQ ID NO: 438489 - DNA, 1259 bp, Homo sapiens
tcagatgtagaggcgtcaccgtgttatttcatgctcggcctgcgctttaatgttatatagtggccatcggcgaacaattacaagctggcgtagtctcctagtgcccagccactggataggtaggacgtacagtctgctagctgctactcagctagagccagctaccaacatggccagatacggaggaccggtaccggaatcgtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 438490 - DNA, 1273 bp, Homo sapiens
caggggacaggctgcagccggtgcagttacacgttttcctccaaggaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagctgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaacca

SEQ ID NO: 438491 - DNA, 813 bp, Homo sapiens
aaactacgggctaggtgcgaggctgggtggtgggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgaggctggacttttgaccgaaggccctatgggaccttgtgcccgccgaccgggattgagtggctgggtgagcccggccggggtgaccggtcccctgctggggggcccggccgggggtcgggccgggcggccccttcggccctg

SEQ ID NO: 438492 - DNA, 1152 bp, Homo sapiens
ggggtcgaactaggctaggtacgaggcctgggtgttcaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggagccctggcctccagtgccttcccccgtggaataaacggtgtgtcctgagaaacca

SEQ ID NO: 438493 - DNA, 988 bp, Homo sapiens
ggggtcgaactaggctaggtacgaggcctgggtgttcaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggattcagcaccttggcacagctgaagcagaggaacacgctgaaggatggtatcatcatgatccagacgctgctgatcatcctcttcatcatcgtgcctatcttcctgctgctggacaaggatgacagcaaggctggcatggaggaagatcacacctacgagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtccggccctttggcaagagctggggaccaggggctggagacaaatgcagcctgaatgg

SEQ ID NO: 438494 - DNA, 422 bp, Homo sapiens
cctcggacgttgtcacgggtttggggtcggggacagagcggtgaccatggccaggctggcgttgtctcctgtgcccagccactggatggtggcgttgctgctgctgctctcaggtacagaacccacgacgaggcctgtggggtttgctctcatctccagctgtctgggccctgcggctctgcctcctgcttgctccaccctcctcctctgtctctcactctttaccgcctgtctccctctcatggccctggggcctgggtctgtgggtgtcagctgcacgtggtgatgggctcaggagcctgtggccccagttcctctcctgcctggagagcatcaggctgagctgggcatgaggagcaaaccagagttagcaaccaggaccgtggaagaactaggctcaggaggaagagaggctgagggcg

SEQ ID NO: 438495 - DNA, 681 bp, Homo sapiens
  misc_feature (681)..(681): n is a, c, g, or t
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaataacccttcccacacaccctctcttggaccccacctgcctgcctgcctttn

SEQ ID NO: 438496 - DNA, 526 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagaggtgagctttagcggggaagattgttgtaccccagggagggggatggctgactggttctcctgtcctttctttcccactaaccccacctcccctttctctcaaccccct

SEQ ID NO: 438497 - DNA, 2982 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438498 - DNA, 3064 bp, Homo sapiens
ttggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcggtgcggggggacttttgatcacaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438499 - DNA, 2958 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438500 - DNA, 2768 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438501 - DNA, 3221 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaaggtaagaaggggagggcgtgtttcctctgacaatttgttctctttcattggctgtttcagctgctctgtctgaatattccacgtgccacatcctgtctcttcctttttcccacccattttatcctctaaatcctcctgtttcttttctcctgtactccagatctctttgactctttgtctctcacttccctgcagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438502 - DNA, 2195 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438503 - DNA, 1687 bp, Homo sapiens
ctgctgcttcttcctcttcgtcctcctcttcatcatcctcctgaccctcctgcatctgttccagatcctcctcctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438504 - DNA, 2944 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggcggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438505 - DNA, 2750 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438506 - DNA, 1476 bp, Homo sapiens
  misc_feature (72)..(72): n is a, c, g, or t
aggcagtaggcacccctgggatgcattccactagggcctcaccagaatcaaggaggcttcgggggtgtcttntgcctccagagctgagacagatgacgaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438507 - DNA, 2205 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438508 - DNA, 2043 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438509 - DNA, 807 bp, Homo sapiens
gcggccgcctactactactactaccactgctcgaattcaagcttctaacgatgtacggggccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438510 - DNA, 3027 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438511 - DNA, 3178 bp, Homo sapiens
ggatgtgttcctggcatttgcccagggtccctcccctcccaggggtcccgtgcgacgtgccttggacaaggctttctttatcttcctggccctcttcctgacactgctgatgctggaggctgcttataagctgctgtggttactactatgggcaaagttaggggactggctcctggggacacctcagaaggaggaggagctggaattgtgaccacctttcctataaacatcttctttccccaccaaggagctcacctctggacccagccttgcctccacgagtccctccagcctccctaaacacaacgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438512 - DNA, 3043 bp, Homo sapiens
ttggggagagctgggcgctgagtctgaggggaaagctgtggtaccttcctgtccctgaaagggagtggagcggccgggggctgaactgggggagggggatttggcgggaagcgcatctagcggaccggccggacccacggttgggatctaagaggaatcgcgagagcgtagcgcgcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438513 - DNA, 2802 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaacaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438514 - DNA, 3062 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagatctctttgactctttgtctctcacttccctgcagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438515 - DNA, 1936 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagcccggctgtcccaaaccccccattcacagcctcctcggcctggtacttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438516 - DNA, 2715 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacggacatttcctcttccaggaagcaatcagaggagcccttcaccactgtcttagagaatggagcaggcatggtctcttctacttccttcaatggaggcgtctctcctcacaactggggagattctggtcccccctgcaaaaaatctcggaaggagaagaagcaaacaggatcagggccattaggaaacagctatgtggaaaggcaaaggtcagtgcatgagaagagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438517 - DNA, 2613 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctgaggagctgaccctggaggaagaaagccctgtgtctcagctctttgagctagagattgaagctttgcccctggataccccttcctctgtggagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438518 - DNA, 2624 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaaaagtgaggagggcgagagaaaaaagagaagagctcggctccaaggcacctcttcccactctgcagacacccccgaagcctccttggattctggtgagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaagaagcagcagcaggtaaagatggagacaagagccccatgtcctcactacagatctccaatgaaaagaacctggaacctggcaaacagatcagcagatcttcaggggagcagcaaaacaaaggacgcatagtgtcaccatcgttactgtcagaagaacccctggccccctccagcatagatgctgaaagcaatggagaacagcctatgtggaaaggcaaaggtcagtgcatgagaagaatgggaaaaagatatgtaccctgcccagcccaccttcccccttggcttccttggccccagttgctgattcctccacgagggtggactctcccagccatggcctggtgaccagctccctctgcatcccttctccagccccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438519 - DNA, 2014 bp, Homo sapiens
ccgtacgacaatatggcggcgcttagttgcatgaaggcggaaactctgtgacttccggtccgtagtggggcctgcggtgggagtgggaaggaaggcggagggaaccatgcgaggttctgagaattgcggcgagggtcgcctcgagagacggtttctgagcaggaattctgaaatccccaccacttcctccctccgggggatttgatcccctatggccaccgctaacagcatcatcgtgctggatgatgatgacgaagatgaagcagctgctcagccagggccctcccacccactccccaatgcggcctcacctggggcagaagcccctagctcctctgagcctcatggggccagaggaagcagtagttcgggcggcaagaaatgctacaagctggagaatgagaagctgttcgaagagttccttgaactttgtaagatgcagacagcagaccaccctgaggtggtcccattcctctataaccggcagcaacgtgcccactctctgtttttggcctcggcggagttctgcaacatcctctctagggtcctgtctcgggcccggagccggccagccaagctctatgtctacatcaatgagctctgcactgttctcaaggcccactcagccaaaaagaagctgaacttggcccctgccgccaccacctccaatgagccctctgggaataaccctcccacacacctctccttggaccccacaaatgctgaaaacactgcctctcagtctccaaggacccgtggttcccggcggcagatccagcgtttggagcagctgctggcgctctatgtggcagagatccggcggctgcaggaaaaggagttggatctctcagaattggatgacccagactccgcatacctgcaggaggcacggttgaagcgtaagctgatccgcctctttgggcgactatgtgagctgaaagactgctcttcactgaccggccgtgtcatagagcagcgcatcccctaccgtggcacccgctacccagaggttaacaggcgcattgagcggctcatcaacaagccagggcctgataccttccctgactatggggatgtgcttcgggctgtagagaaggcagctgcccgacacagccttggcctcccccgacagcagctccagctcatggctcaggatgccttccgagatgtgggcatcaggttacaggagcgacgtcacctcgatctcatctacaactttggctgccacctcacagatgactataggccaggcgttgaccctgcactatcagatcctgtgttggcccggcgccttcgggaaaaccggagtttggccatgagtcggctggatgaggtcatctccaaatatgcaatgttgcaagacaagtgtggccacacaatgcgatccagaagagatcatcgtgctctcagactctgattagctgcctccccttctccctgcctccagaatgttctgggataacatttggaggaaggtgggaagcagatgactgaggaagggatggactaagctaatccccttttggtggtgtttctttaaaaaaaaaaaaaagcttaagttttacacagaaacattaataaacaataaagttcttttcttactgtaaaaaaaaaaaaaaaaaaaaaaaaaaaaaaaaaaaaaaaaaaaacaaaacaacaaaaaaaaaaaaaaaaaaaaaacaacagacgggccgcgcggcgcccccccaaaaacccccccccggcgcgccccacaccccccccccccccattttgtatagatacaaagggcgcccccacttgagtgagcggagatcaaatttatataacaggaaacgcgaagcgtcgcgccgcgctgattattatataaaccatagattaagtagagtgaagaaaaaacagtgatctgaagggggcgatcatttggtcgagggaagccaaacctaatttttgttggtgtgtggccatcacacatagtgaggcaacaactccccgctgtgaaagttattaagagcgactagggggagaactatcc

SEQ ID NO: 438520 - DNA, 334 bp, Homo sapiens
agagagacattgtccttcccctgcactggccaccagggagtccaggttgactgatgggggagcatgagaaggaaagcaagaaccaaaccctctggggcaagggattccttagagaaacttctttgtctcccagggccctagtggaatggcatcccaggggtgcccttctgcctccagagctgagacagatgacgaagacgatgaggagagtgatgaggaagaggaggaggaggaggaagaagaagaggaggaggccacagattctgaagaggaggaggatctggaacagatgcaggagggtcaggaggatgatgaagaggaggacgaagaggaa

SEQ ID NO: 438521 - DNA, 3470 bp, Homo sapiens
  misc_feature (2146)..(2146): n is a, c, g, or t
gtagctggaaggggaggtggggcaagggaggggacccccagcctgtcacctgggttgcctgcatggtactgagtgagctggtggcttctgtgtgggcctctggctgtggggatggtcagacaggaatagacacaatgctgcccaccctctgcatgcatgtgtgtgctggcatgcacacacacgtgtgcacacacatctacatgcacatacccacacgtgcatacatacatgtatagacatacacctttgtgcatacacacaggtatagacatacacctttgtgcatacacatacattatacacacatgtacatagacacacatacacatgtgcacacacctataggcagagcccactccttttcccctgatgaggttgtggtggtattaataatcataatggtagatgatatttactgaatgcttactgtgcatgatatgttccactgacagttttacatccattatcttaatcttcacagccccttgtgggataggaagttggccacattgcccacatccagtagccagtgaatagttgtgcttggagtttgccctgtaggctgacttatgagccatagcccaagccacatcccgagaacacacaatacggggagcccctccttaggggaaaatttctttccaaaatatcacctcataccttgctcagggaatactctttcggttataagtaataggcgtctaattcacaccagctagaggcccaaggcagcctcaggcggggctggaggtatgagcagcagctggcactctcccttcccaccagcccacaccagccatgcttgcctgtctctgcaaacgcagtctctgcttctctcatagcaccagccgagcgcagggtagtcacacctgtccctcaacccctccagattcttgggagggagagctggggtgtgtccagcattgtttcttgagtctgaggtcgggggttcttctggagatgcaggtcagtttatgcctgcaacaattctcctccctcaccaaagggccctgcctctggaggggcacctgtcttctccccatggtgcctacttccccttctgtctcattctccagagccaacatcagtctccctctctggaccttctacttggggtctgatcttggggctgctcagacatcagaatccctgagctcctcaggggttgcccctcttggctaagccctgcagcagcccctcctctcagtggcctgggggcaactttaagatctctcctcctgtaagtcagaaggcaggttctcctcccatagaatccagtccgtcgacagagttagatgcctcttcctctttgtcctattgtgcttaccacattacgttgtcctgtgctagtttgtttttctgtctcctctgaagttcccaaaggatggcttattattcagctaagtggtacacaacctggggccagtccatggtaggcacttaataaagtcttgtcaggaaggtggatgaatgaacgcttaacacacaggtgtgtgtgtatctgctgtgctccttgctagggggatctccagctggttgtctctggtttgtgtcagatgcagccctgccttgacagaagctgtttctgactccctgtgtaacactaacaggactttcttttacctcctgtagccaaacaaagtcaggaatgaaactaaagagctgaggttgctctgtgcagaggacgagcaaaccaggacgtgctggatgacagcgttcagactcctcaaggtatgtgacatcttgcggtttgtgttgagtgcacatctcttcgtggaaaattggcctctggacttgatgtctattctggcaggaaaatgctcgtaacttttccgctgttctgtcacaatattttatttatcaaatgtagttaagcatctttctaaacaagatctcaggagcttttaacagagggcctaatattaaacagggtagagctaggttttccggactcagtactactgacattttgggtagaataattctttgtcgggggtctgggggacatccaagcattgcaggccacttagatgtgtggcatacctggtctctgcctgctagatgccagtcgcacgcccggccagttgagacaaccaaaaatgtctctaaatgttgccaaatgtgccctgaagccagaggatggggnattgcccctggttgagaccactagattagaagaataggattcgaaaaatcaggaccagggagaaaggaaatagtacatgaggtgttaattattttcacgactgaaccaactctcaggttcccaaaaagccagggccatgaagtaaacatgatgaattatacagttgactgaagctcctcagcagagacagtacctcctgactgtaagttctaaaggaaatttatcacgtggtactgcatatagagtaatgcccttgacagcaatttcatgccagttgccagagtgatttcatagggctgtttactgtagtcactttggatttcccacagtgtttctgtgcacatataccatatcccacatgtctggaattaagtctacagagtccttgtgagttgtaagttagctggcccaggtgagcttggctaaagtccaggggtctccataggagatgttcgtttagtcaactggagccaatggatacaatggtctagggatttctttacaaaaactcccagccttcgttgaactgtagtggcctttgagctggtccagagactcaaggtgaagtcaattaaggagatggaggaactgaaggaagcatagctcaaaactttcctggaggtgctgcagatccaattctgaatgtagtcctgttgtcccatccacttggcaggtagcattttgcacccagtaatccacagattccagagacattaaggatacatcctagtgccatttttataggatgctggggcccaaaccaaaagttccacagattggcttcctgtatctctctcccagaaccttattttatgttttcactgattaaaaaaagaattatggaaatcaaaactttacaaattcataatggaagaggaaatgtccatgttaatacatcatagatcatagaccactcctgtgtaagccggttttcagtgtaagggtcatcagtgggaactggtcacataggtgacatccattgagggcagtattctgcatggacctccagaaagaatgagattgctctttgtgtcctgttgcggaaaaattactaacaattaaaaagcaaagtacagaacagtatatagagagaaggctacatttgtgtgaagggaacaggaaaaattggaatatttgtatttgatggtatgctcatgaacattgtgtgagctgcaggagagaagaaagaggttgcttagtagggagaggagatgggagaggcagctgtgcagataggggcagcggccaggggtgatcttttgaagctgtctgtatatggttgaaattttaatctgcaaatgaatcatctgttttggaaaaggca

SEQ ID NO: 438522 - DNA, 4795 bp, Homo sapiens
  misc_feature (13)..(13): n is a, c, g, or t
ggcgcaactttgnctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438523 - DNA, 5453 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438524 - DNA, 4685 bp, Homo sapiens
  misc_feature (13)..(13): n is a, c, g, or t
  misc_feature (4685)..(4685): n is a, c, g, or t
ggcgcaactttgnctcccagggaacaaacatcctccttctaagtggtagatgtgggtgagctgaccctgctggagtctgtcccctgggctaccctctgcttccccccattgtgagtggtccgtgaagcacagcgttgaccagacctaaacctgtttgctcccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctggggggagtggggcattgtgaggtccggactggggaggaatggcgggtataagtggaggaaggtttaaggaactttcgtgtggttctcaattgtgggcataaccaatgaagagggttgcgaacactcttgaaaaagggggctgggtgttgttgtactggtcgtaacttgn

SEQ ID NO: 438525 - DNA, 5315 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438526 - DNA, 5219 bp, Homo sapiens
gtagctggaaggggaggtggggcaagggaggggacccccagcctgtcacctgggttgcctgcatggtactgagtgagctggtggcttctgtgtgggcctctggctgtggggatggtcagacaggaatagacacaatgctgcccaccctctgcatgcatgtgtgtgctggcatgcacacacacgtgtgcacacacatctacatgcacatacccacacgtgcatacatacatgtatagacatacacctttgtgcatacacacaggtatagacatacacctttgtgcatacacatacattatacacacatgtacatagacacacatacacatgtgcacacacctataggcagagcccactccttttcccctgatgaggttgtggtggtattaataatcataatggtagatgatatttactgaatgcttactgtgcatgatatgttccactgacagttttacatccattatcttaatcttcacagccccttgtgggataggaagttggccacattgcccacatccagtagccagtgaatagttgtgcttggagtttgccctgtaggctgacttatgagccatagcccaagccacatcccgagaacacacaatacggggagcccctccttaggggaaaatttctttccaaaatatcacctcataccttgctcagggaatactctttcggttataagtaataggcgtctaattcacaccagctagaggcccaaggcagcctcaggcggggctggaggtatgagcagcagctggcactctcccttcccaccagcccacaccagccatgcttgcctgtctctgcaaacgcagtctctgcttctctcatagcaccagccgagcgcagggtagtcacacctgtccctcaacccctccagattcttgggagggagagctggggtgtgtccagcattgtttcttgagtctgaggtcgggggttcttctggagatgcaggtcagtttatgcctgcaacaattctcctccctcaccaaagggccctgcctctggaggggcacctgtcttctccccatggtgcctacttccccttctgtctcattctccagagccaacatcagtctccctctctggaccttctacttggggtctgatcttggggctgctcagacatcagaatccctgagctcctcaggggttgcccctcttggctaagccctgcagcagcccctcctctcagtggcctgggggcaactttaagatctctcctcctgtaagtcagaaggcaggttctcctcccatagaatccagtccgtcgacagagttagatgcctcttcctctttgtcctattgtgcttaccacattacgttgtcctgtgctagtttgtttttctgtctcctctgaagttcccaaaggatggcttattattcagctaagtggtacacaacctggggccagtccatggtaggcacttaataaagtcttgtcaggaaggtggatgaatgaacgcttaacacacaggtgtgtgtgtatctgctgtgctccttgctagggggatctccagctggttgtctctggtttgtgtcagatgcagccctgccttgacagaagctgtttctgactccctgtgtaacactaacaggactttcttttacctcctgtagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438527 - DNA, 3277 bp, Homo sapiens
  misc_feature (3251)..(3251): n is a, c, g, or t
  misc_feature (3262)..(3263): n is a, c, g, or t
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgataactgtcaaaaaaaaaaaaaaaaaaaaaaaaaaaaaaaaaaaaaaaaaanaaaaaaaaaanngcagaaaaaaaaaa

SEQ ID NO: 438528 - DNA, 2085 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccacacaagaaccacagggtaccgagctcg

SEQ ID NO: 438529 - DNA, 1714 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattaggtagggaaccatcagaacaggattggcacctggggatgcttatgtgcaattgaatgaagactgctgctgccaaatgccaaatgtgtgaccgcagtgtcccctgcgaaattagcaggcagtctctgggttcccctcgactctcctgtttctcctaaaatttcactctcctccctccagcccctttcccctagtactttgggaatcttgcc

SEQ ID NO: 438530 - DNA, 543 bp, Homo sapiens
tctccagggaggaatcccacaggatcattaaacagcaagggctcgtggatgggtaaggaaccaccactgataagagctgtcatctgctaaggttttattgtgctggggatctgttctgtttaattcctcagacatccttgctggacaggcagcagttttgtcctcattttaaagaggagaaaaggtaggctagaggtataagtggtacgcagggcttgcccagctagtaaggggcagaaagggatctaatccatgtctgcccagagtgtatctgtaattatccttcacctctgtatgaaatctgaagagatggacaacacaagttgttttatcttcataaggtagtgggcagatggaaaaaaaatgcttttgcctacgctttttgattgtgtactacatgaggttggttttgctgagaacaaatagccccaaaccttagtggcttaaaacaacaaaaataaattacgtatcattgttggttgagtggcctttctcacctgggccagcttggctggggctggacagtccaggataggttcactc

SEQ ID NO: 438531 - DNA, 5445 bp, Homo sapiens
ggcagccgggcgccccgcggggctctccgcgctgcgttcccgacccctggggggaggtgtggagtccaagcggtgcattcttgaaccatcttgtcagacgccggcggctcgcgggctgtggcgggggctgcggtcaaggccgcgctcctgggggccgccgcctgggagggtgggcgcccaggcgtccctgcagccccgggtgctccgactgcgcggcggggccgcggcgcgcgcgcccgggcgtccgggcgtccgggacagtggtgccagacactcccaaatcccgagccggcccagcctcgtacggaggaccttttttttggttctgttggtgacccgttagccgccgctggggcctaacaccaagttgagggctcgcggattagccgcccgccagccgtggaaatgtgataagagcggtaccgtttgcagaaggaaatttctgatgcaactcttcgcctttgctgattgcctctccaaacgcctgcctgacgactgccttggagcatgtgcgttatggaaattaggctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggttctgaaaatattgtgcacagggcaggctgaggacacagccacgtgatacccactgtagagagagggagagagagacctcctatgcaagctgccggccctctgttccgtagtaaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438532 - DNA, 5733 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438533 - DNA, 5623 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438534 - DNA, 5526 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgatatgtttactttttttgtattgatcacttttttgcactccttctttgttttcaatattgtattcagcctattgtaggagggggatgtggcgtttcaactcatataatacagaaagagttttgaatgggcagatttcaaactgaatatgggtccccaaatgttcccagagggtcctccacaccctctgccgactaccacggtgtggattcagctcccaaatgacaaacccagcccttcccagtatacttgaaaagctttcttgttaaaataaaaggtgtcactgtggtaggcatttggcatattttgtggactcagtcaagcaaccacagtctgttaatcatttctctatgctcagatgtcagatcctcttgttattagtgtgtcttgttctgcacagtgcaggagactttattcctttggaaaattcactgttccacaaacagcaggctgaatggcctcgcctctagattgacgtgggccagcctccttgagacacacctggcacccgtcatcggccagcggtggatgctgcataatccacctgggtacttcagccttgcgtttccacagccttcagcctgttctagaacgatcactgccttacccctgctgctgcagtggtgtgagtcgtttcacggctgatgtccctcgggggattaaaggatctaaagagaaaatggcacctggttgtcttcgtgctgtgtctcatgggtttccatagtgataaagacaaggaaacgctgcaggggccacaggcacaggctgatatttaaagatctttgcttgcagccctccgtcctgctgaaaacccccataagccagtgaacacagagcagctagaggctcctcctctgctggcttagggtcagaagtacctcacagtggttgtggacatggaagagttttgtcaacacaacactttgtccccgctccgggagatgagtcagatggtggcttgagttgtcacttggtcccctccgcccctcgggtggccccctttgccacgtccccttagcttagtgatcaggtgtgagagtggccatttccttacctttgatccctgtaaagcagaaaggactcctttgacaggcgacaaactactgtggtgagcagaatgatttcctttttcaagacaacacctgcctggcttctattaatgtgtgctggccatgatattgccccaaatccgccccactgaagtgttccctaaggaacagcatttctctgctcctcagtcaacccccgtagcctagagcagtgtcacaagcttcagtaaggccagtcagctggaagtcagtctaccgtatagtaacactgtatttcagtctacagaccacactctagttgttttccatgaaaggtatacaaatgaagaattttctagcaaaacatgtttttaaccatcagtgctcaattgcattttcttcctttcgcagccagtcagtctttcaaactattgacagtaagataattctcacgttcacacctggtggcaggcttcactgtagggacggacattgcagttacaccacgattccttcctcttcactggctcgaggtaaacccttttcaaggaaaaacaactctaggatttcttttttctgtgtacgtagaccagtcccatcagtgtataatctctctctcacacgcctctctccaatagacagcttgtatttgcagtatttcatatttataaatatgcgtttatttaaaaggagaacaaaagcttgactctgattcacagttttgtatgtagctggtttgacgtagtcttttgtattttccctgccgaagtgaattgttggagaatgtaaaccgcctccacgtggcggcagacttcctaaggccccagctcgctggcctcgcgctgggcggctgggaattccacctgagaacaagtcccgcaaaccggggacggaaggacatttgacttttatttttgtatttaattgacatgaatgtaaaggggacagctcagggttgttttggagcctgttgactttgtatctctgcctgtgattttcttttctaaatgaaactccatgtagcaaccaggacgaagttgagaaggaaaacgccaaatgctttggttattagagtttaataggtaagctctgttacactaggtgttagagttccagaatgttcttttgtttgctaaaccttgaagaaacatgtgcctcagcctagatgttttgtcttctcttttctgcacttaatacctgacagtatgaccgatctctgcgcctttctgggggcgggcaagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaattagaaataaacattaatacagtgttcttcattttcaaaaaaaa

SEQ ID NO: 438535 - DNA, 3242 bp, Homo sapiens
  misc_feature (3216)..(3216): n is a, c, g, or t
  misc_feature (3227)..(3228): n is a, c, g, or t
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagacttgggaggctgcattctgataattctcaggaggaagaatgtataggagagaccagggtttttaaggtgtgacctctgaaccacctacatcagagctgactgcctctcgctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggtgctgcagcgcagtaaatgtaatttgaagaaggcagaaggaacccatggctttagccggctgcccagattcctttttgcaccatccgtactaccaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcagaattttctgaactccagtagttgtcctgaaattcaagggtttttgcatgtgaaagagctgggaaagaaatcatggaaaaagctgtatgtgtgtttgcggagatctggcctttattgctccaccaagggaacttcaaaggaacccagacacctgcagctgctggccgacctggaggacagcaacatcttctccctgatcgctggcaggaagcagtacaacgcccctacagaccacgggctctgcataaagccaaacaaagtcaggaatgaaactaaagagctgaggttgctctgtgcagaggacgagcaaaccaggacgtgctggatgacagcgttcagactcctcaagtatggaatgctcctttaccagaattaccgaatccctcagcagaggaaggccttgctgtccccgttctcgacgccagtgcgcagtgtctccgagaactccctcgtggcaatggatttttctgggcaaacaggacgcgtgatagagaatccggcggaggcccagagcgcagccctggaggagggccacgcctggaggaagcgaagcacacggatgaacatcctaggtagccaaagtcccctccacccttctaccctaagtacagtgattcacaggacacagcactggtttcacgggaggatctccagggaggaatcccacaggatcattaaacagcaagggctcgtggatgggctttttctcctccgtgacagccagagtaatccaaaggcatttgtactcacactgtgtcatcaccagaaaattaaaaatttccagatcttaccttgcgaggacgacgggcagacgttcttcagcctagatgacgggaacaccaaattctctgacctgatccagctggttgacttttaccagctgaacaaaggagtcctgccttgcaaactcaagcaccactgcatccgagtggccttatgaccgcagatgtcctctcggctgaagactggaggaagtgaacactggagtgaagaagcggtctgtgcgttggtgaagaacacacatcgattctgcacctggggacccagagcgagatgggtttgttcggtgccagccgaccaagattgactagtttgttggacttaaacgacgatttgctgctgtgaacccagcagggtcgcctccctctgcgtcggccaaattggggagggcatggaagatccagcggaaagttgaaaataaactggaatgatcatcttggcttgggccgcttaggaacaagaaccggagagaagtgattggaaatgaactcttgccctggaataatcttgacaattaaaactgataaaaaaaaaaaaaanaaaaaaaaaanngcagaaaaaaaaaa

SEQ ID NO: 438536 - DNA, 1877 bp, Homo sapiens
gcggccgcgatgtcccccgcctgtctgcgaatgcggcgtagcgggtagacatggagggctttcggcatcgtcagagtggccagtgtgcgcgtccttgcccatcaggcgggggggctgtgggggaggagaggaggcagtggagggaacaaggggttcttcagggttgccatgagaaccagggatccggggattgggcagcagagggcccccgccgggcgttggggcgtggccgcgtcacatgggtttggtcctgggattcctgttgtgctccaggaccgggcgctgctccgtcgtcctcccgctcctcaggagcgcccagtccctcggaggctgagtattgcagccgggcggcagccggctccgcggaggggcccccgggcacctgcgtggtgatggcgctgggagcccccgggcacgctcgggcggtggcgcggcatcccaccctcgcccggatggcgtccccagaggcggcgttggcccgcttttcgtgctagcgcgttcgcctggcgcgcggtggccccgaggccccgggtcggttttctgcgccgcaggcccctggccggggcggagccgtggaggaccagcccggcccggctccgagcgctgtccatgcggagcgctgtccacgcgccgggcactgcgggggccgggccccgaagccctacccgggccggcggcgcacacgcagcgaccccgtgcggccagtgctgccgcccgctctccagctttggcgctgaccacaatgctgagcaggaagcagcagctgcaggcccagtgactggtagctcagtgaccagcagcccagtgaccggcagccaggtcctcacctgggtcctctcagtgaagccagggtggccgccccagcagacagtgctacagagccaactcctgacaggacaaggtggagcagacacctcgcagtcaacaagacccggcaggaccaggactccccgcacagtctgaccgacttgcgaatcaccaggaggatgatgtggacctggaagccctggtgaacgatatgaatgcatccctggagagcctgtactcggcctgcagcatgcagtcagacacggtgcccctcctgcagaatggccagcatgcccgcagccagcctcgggcttcaggccctcctcggtccatccagccacaggtgtccccgaggcagagggtgcagcgctcccagcctgtgcacatcctcgctgtcaggcgccttcaggaggaagaccagcagtttagaacctcatctctgccggccatccccaatccttttcctgaactctgtggccctgggagcccccctgtgctcacgccgggttctttacctccgagccaggccgccgcaaagcaggatgttaaagtctttagtgaagatgggacaagcaaagtggtggagattctagcagacatgacagccagagacctgtgccaattgctggtttacaaaagtcactgtgtggatgacaacagctggacactagtggagcaccacccgcacctaggattagagaggtgcttggaagaccatgagctggtggtccaggtggagagtaccatggccagtgagagtaaatttctattcaggaagaattacgcaaaatacgagttctttaaaaatcccatgaatttcttcccagaacagatggttacttggtgccagcagtcaaatggcagtcaaacccagcttttgcaggtactgggccacaatagatctctgctgaaatagactttctgaatagaaatcctcttggaactgaatggcagcattgtaaaaaacctaaagagatcgcatctttcaccatttataaccttggctcttaagccggaggggtggttggggggagggtttagagtaaccagaaattaaaagtttccttgga

SEQ ID NO: 438537 - DNA, 5425 bp, Homo sapiens
  misc_feature (957)..(957): n is a, c, g, or t
  misc_feature (1002)..(1002): n is a, c, g, or t
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcancctcctgggttcaagtgatcctcctgcctctcagccttccgagtngctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattctgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaaaaaaaac

SEQ ID NO: 438538 - DNA, 243 bp, Homo sapiens
cctctgattctggtcttctctggccacaggctatctcacctggaattacgttctgaatgaagctatcaggttgtctctaatcatgcagcttgttgccttgctgttggtagtgctgtggataaggtggaagtgtcggagactcagaatcagaggggtcagcactcaagccagcgggtggagaaatgcatagttctcagaggcaagaggagtaatcagaactgcattcactgacatcccccccgg

SEQ ID NO: 438539 - DNA, 4414 bp, Homo sapiens
gcctttctcctttccttcccggatcccagacctgcctcgatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaaaaaaaac

SEQ ID NO: 438540 - DNA, 2279 bp, Homo sapiens
gagaatcagcagaaccccaagaaaaattctacctttttactagcctccattgcctgccctgatcacactgaggactcatctggaggtagtgaggggtggggttgaagggtccctgtgtgagaagtccatctgcaaagtggatttaccttactttttaaatgcacttacttaaaagcaaagaagcctccgagaaccaatatttgctatatttgctttctctctttcttgttcttaatttggttttgtgttgtattttgttttttgtttttgtttttgttttttgccttctagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaaaaaaaac

SEQ ID NO: 438541 - DNA, 2822 bp, Homo sapiens
  misc_feature (957)..(957): n is a, c, g, or t
  misc_feature (1002)..(1002): n is a, c, g, or t
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcancctcctgggttcaagtgatcctcctgcctctcagccttccgagtngctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggtgggtgtggctatggctgctggcatctggcaattgttgtcccaggtatcatggctggctgagctagggtttctgattttactttcctcagccagtttctaggccctgcaaggccccatgagctacagtcgtttgaagttttactgagatataaattagaatggcatgtgctgcaaggcagatgtatgggagccaatcatttggctagtaaaggagcccagccaactggccagcagcttcagctcatcacagctttgttgttctcaacttgttgaatatcatgcattcattcattaattcaaccagtatttattgagcacctaatatgtgccaggcactgccactgcaatcttataaatggagttttaaatttgcaaatgtattttatttgtaattgttatttttatgtgtggaaaacagaatggattgctagtgttggtgagtaaaaacaaaaaaaaacaaatgacaaagaatgtgatagctcatattttagaaatggctttataaatcaccttggttccctatcagtagagctagtaaggcagcaccaatctctaaatatagaagaaatttccccaaaatgtaaaatgccagacatgtcccagcccgaactcccccaccccatggcctggaggtttctagatggaattggccacatttgctttagtctctctatccagctaaataggcttggggaaagctgtggtgctacagaaagtaccctagacttagaagcagtaatactggtttctagttctatttctgacactgcctccctgtgtggtcttgagcaagtcacttcacttttctgtgctttggcttcctctactctaaaaatgggataacagtatctatctgatctactgtgtaatgcttctctctgtgcctcagcttcctgatctgcaaaattggtttaataataatgcctacctcacagggttgttgtgaggatttgcctaaatatatatgtacagtgcctggcatataagttctcaataaatggtagatatt

SEQ ID NO: 438542 - DNA, 5452 bp, Homo sapiens
  misc_feature (957)..(957): n is a, c, g, or t
  misc_feature (1002)..(1002): n is a, c, g, or t
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcancctcctgggttcaagtgatcctcctgcctctcagccttccgagtngctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctttacaagagctttcctctcctctctcttgctctcagagacctataaatccaaccagttaccctgcaagtcagccccatctgctgttccttggtctctaatcacctgagctgggtaaaggggattctgggagttgagagctctgccagggtgagatgtttcctgaagagaggttccccacccctgtaactcctcactgtactgatttactggcgcatgaaattctattaaaaatgcattcttctgaataaaaagagtattcactatttaacttcaaaaaaaaaaac

SEQ ID NO: 438543 - DNA, 5223 bp, Homo sapiens
  misc_feature (957)..(957): n is a, c, g, or t
  misc_feature (1002)..(1002): n is a, c, g, or t
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcancctcctgggttcaagtgatcctcctgcctctcagccttccgagtngctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcagagaagcctggttgctgggaacagctcaaggggtcaccatgctcttcatagtcacggcccttctctgctgtggactgtgcaatggggtattgatagaagagactgaaatagtcatgccaacccctaagcctgagctgtgggcagagaccaactttcctctggccccgtggaagaacttaaccctctggtgcagaagcccttctggctcaactaaggagtttgtgttgctgaaggatgggaccgggtggatcgccactcgcccggcctcagagcaggtccgggctgccttcccccttggcgccctgacccagagccacaccgggagctaccactgccattcatgggaggagatggctgtatcggagcccagtgaggcacttgagctggtggggacagacatcctccccaaacctgtcatttctgcttcccccacaatccggggccaggaactacaactccggtgcaaaggatggctggcaggcatggggtttgctctgtataaggagggagagcaagaacctgtccagcaacttggtgctgttggaagagaagccttctttacaatccagagaatggaggataaagacgaaggcaattacagctgccgcactcacactgaaaaacgccccttcaagtggtctgagcccagtgagccgctggagcttgtcataaaagaaatgtaccctaagcccttcttcaagacatgggccagccctgtggtcacccctggtgcccgagtgactttcaattgctccaccccccaccagcatatgagctttattctttacaaagatggaagtgaaatagcatccagtgacaggtcctgggcaagtccgggggccagtgcagctcactttctaatcatttcggtgggcattggtgatggagggaattacagctgccgatattatgacttttctatctggtctgagcccagcgaccctgtggagctcgtggtgacagaattctaccccaaacccactctcctggcacagccaggtcctgtggtgtttcctgggaagagtgtgatcctgcgctgccaagggactttccagggcatgaggttcgccctcttgcaggagggagcccatgttcccttacagtttcggagtgtctcagggaactcagctgacttccttctccacactgttggagcagaggactctgggaactatagctgtatctactatgagacaaccatgtcaaacagggggtcatatctcagtatgccccttatgatctgggtgactgacacattccctaagccatggttgtttgctgagcccagttctgtggttcccatggggcagaatgttactctctggtgccgagggccggtccatggagtaggatacattctgcacaaagaaggagaagccacttcaatgcagctctggggatccaccagtaatgacggggcattccccatcaccaatatatctggtactagcatggggcgttacagctgctgctaccaccctgactggaccagttctatcaagatacaacctagcaacaccctggaactcctagtcacaggcttactccccaaacccagcctattagcccagcctggtcccatggtggcccctggcgaaaatatgactcttcagtgtcaaggggaactgccagactcaacatttgtcctgttgaaggagggggctcaggagcctttagagcaacagaggccaagtgggtacagggctgacttctggatgccagcagtgagaggtgaagactctgggatctatagctgtgtttattatttggactctactccctttgcagcttcaaatcacagtgactccctggagatctgggtgactgataagccccctaaaccctctctgtcagcctggcccagcaccatgttcaagttagggaaggacatcacccttcagtgccgaggacccctgccaggtgttgaatttgttctagaacatgatggagaagaagcacctcagcagttttcagaggatggagactttgtcatcaacaacgtagaaggaaaaggcattggaaactacagctgcagctaccgcctccaggcctaccctgatatctggtcagagcctagtgatcccctggagctggtgggggcagcagggcctgttgctcaggagtgcactgtagggaacattgtccgaagtagcctaatcgtggtggttgttgtagccttgggggtagtgctagccatagagtggaagaagtggcctcgactgcgaaccagaggctcagagacagacggaagagaccagaccattgcccttgaagagtgtaaccaagaaggagaaccaggcacccctgccaattctccttcatcaacctctcagagaatctctgtggaactgcccgttccaatataataatctcctcctctgtgccctcctctatgctgcctcctctgtgctgtcgggatcctctagaacgccat

SEQ ID NO: 438544 - DNA, 3046 bp, Homo sapiens
  misc_feature (957)..(957): n is a, c, g, or t
  misc_feature (1002)..(1002): n is a, c, g, or t
ctccctgaccccttgcgcttcccgagtgaggcaatgcctcgccctgcttcggctcgcggacggtgcgcgcacccactgacctgcgcccactgtctggcactccctagtgagatgaacccggtacctcagatggaaatgcagaaatcacccgtcttctgcgtcgctcacgctgggagctgtagatcgcagctgttcctattcggccatcttggctcctccattctgcttttaagatacaagtgatgccttcaaatttgagctcagtttcttatggtcgtttaggagcatgagggtttctgcaataatctaccagtgaaatgatgatcaagatcttggaaagcactctactggtcaagcagaatagttcctgtcatctccattaagaatcagcttattggccgggcgcagtggctcatgcctgtaatcccagcactttgggaggctgaggcgggtggatcacgaggtcaggagatcgagaccatcctgtctaacaaggaatcctttctggcactcaagagttttcaattcaatcctgatgaatgaatcattatttgataccagcctaagtgaagactctgcctggtgacttttgcaaggtggtttctggctgcaacatgggaagatttgggatcagtgagatggaagagatttttctggctactagcgttcctaagaaagagctttagtgtttatccagctattggtatgcagacaactatacccttatgagaaacactagcagagaagaagagttcttgactgggtctgggccatgaaactgaccggataaaagtgggagaagaagagatgttgaaggaggagtttgctgttttctcagtctcctgagaaattccagatatcttctttctacacacatcctggagaggggaaagaaagcctctctctgtcacccaggctggaatgcactggtgccatctccactcactgcagcttcancctcctgggttcaagtgatcctcctgcctctcagccttccgagtngctgggactacagtttgctgcatctggaggagctcactggagaatctccaacatcggagcgggccttcaactaccatcccaccacctgctgaggagaaaaattcttcaagactcagagcacacagccagcaccagaggccccatgaccctggacagaccaggggagggggccaccatgctgaagacattcactgttttgctcttttgcattcggatgagtctgggtatgacatcgatagtgatggaccctcaaccggagttgtggatagagtccaactacccccaggccccttgggagaacatcacgctttggtgccgaagcccctctcggatatcaagcaagttcctgctgctgaaggataagacacagatgacctggatccgcccttcccacaagaccttccaagtttcattccttataggtgcccttactgagtccaatgcaggtctttaccggtgctgctactggaaggagacaggctggtcaaagcccagtaaagttctagagttggaggcaccaggccaactgcccaagcccatcttctggattcaggctgagacccccgctcttcctgggtgtaatgttaacatcctctgccatggctggctgcaggatttggtattcatgctgtttaaagagggatatgcagagcctgtggattaccaagtcccaactgggacaatggccatattctccattgacaacctgacacctgaggatgaaggggtttacatctgccgcactcatatccagatgctccccaccctgtggtcagagcccagcaaccccctgaagctggttgtagcaggactctaccccaaaccaactttgacagcccatcctgggcccatcatggcacctggagaaagcctgaatctcaggtgccaagggccaatctatggaatgacctttgctctaatgagggttgaagacttggagaagtccttttaccacaagaagacaataaaaaatgaggcaaatttcttcttccagtctttgaagatccaagatactggacattacctctgtttttactatgacgcatcatatagaggttcactccttagtgatgtcctgaaaatctgggtaactgacactttccccaagacctggctacttgctcggcccagtgctgtggtccaaatgggtcagaatgtgagcctacggtgtcgaggaccagtggatggagtgggtcttgcactctataagaaaggagaagacaaaccacttcaatttttggatgccaccagcatcgatgacaacacatcattcttcctcaacaatgtaacctacagtgatactggcatctatagctgccactatcttctcacctggaagacctccattaggatgccatcacacaacactgtggagcttatggttgtagataagccccccaaaccctccctgtcagcttggccaagcactgtgttcaagctaggaaaggccatcacccttcagtgccgagtatctcatccagtactggaattttctctggaatgggaagaaagagaaacattccaaaaattctcagtaaacggagacttcatcatcagtaatgttgacgggaaaggcacagggacctacagttgcagctatcgcgtagagacacatcctaacatctggtcacatcgcagtgagcccctgaagctgatggggccagcaggctatctcacctggaattacgttctgaatgaagctatcaggttgtctctaatcatgcagcttgttgccttgctgttggtagtgctgtggataaggtggaagtgtcggagactcagaatcaggtaactgtcttgtcccagccccctgttccccaacctaacagagtctgaagaatgagtcatgccctagttgagacaagccacagaggcaaaccctatagaacccctatcttctgggcttagggaacaagactttctcaccccacctgtctctttcgcctcacagaggggtcagcactcaagccagcgggtggagaaatgcatagttctcagaggcaagaggagtaatcagaactgcattcactgacatcccccccgg

SEQ ID NO: 438545 - DNA, 791 bp, Homo sapiens
ggtcgcatgtgccctcttccttgactacccagggactcctgtttctctttaacgtgtcaccccgagaagtttctgccccatcctcaggccatagccctagaagtcaattgtacccgtatccccctccccgcccccgcagtaattcatgtccctgtccgtgttgtactccctactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatactggtgctgtccgccctgcagtccccacaggaggccctccatacccccatgccccgtatggtgctggtcgagggaactatgatgccttccgaggccagggaggttatcctgggaaacctcgcaacaggtgaggagggcagacgcccaagctttgttgccgcctgcagactcccttttgggagccctcagctctcatcctgtacctctcacctcacagatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438546 - DNA, 449 bp, Homo sapiens
cctacctcttgttgaattttgggtagtatccaaaatgaatatctacagttaatctgaaaaggcctttccaactccttatcagtatgaggcctgattttctgttttttttttgagactgggcaacagagagataccctgtcaaaaaaaaaaaaaggaaattaaaattttggaaaacttctactaatgtgagcttgacagcttcccattaagtaaagactttcttggtgagataggcagtgatgctgatgagtacattttgatattgggtgagacataatccaggtccattgaaagggaaagatagaacagtggattttaatgcagcagagaaagaaatattcactgatactatttcagattgaaggttctaactagcctgtgagaaactacttcctctgagaattttttgtacgatcagccttactgctaataaaagcacttccacaggg

SEQ ID NO: 438547 - DNA, 3127 bp, Homo sapiens
gtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438548 - DNA, 3000 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438549 - DNA, 2901 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438550 - DNA, 3074 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagacagggtctccctctgtcacccgggctgagtgcactggtgcagtcgaagcttgctgcagccgcgacctgcccagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438551 - DNA, 2398 bp, Homo sapiens
cccggagggggcccgggtcccaggtcgctatcaggacccgagcaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438552 - DNA, 2254 bp, Homo sapiens
ttctccgtgcctccttccatcttaatcacggctgcatccagcatcttgacaatggcatctgttttgtctttccctcccccgcttcgttcccaggtgtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438553 - DNA, 2196 bp, Homo sapiens
tgcgggtctcttccttgacggcacaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438554 - DNA, 2020 bp, Homo sapiens
cagaaacagacctccagaccccatcaccacccagcaggaaatcccaaccacacgtcttagcctcaatcacccctcagagaaaacatgccccccagaccactggcccacatccttggcctcccagacctgagcaagccaggcctggcttgctcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438555 - DNA, 3514 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggaaaaaaaaaaaaaaaaaaaaacaaaaaaaaaaaaaaaaaaaaaaaaaaaataaaaaaaaaaaaaataaaaggataaaaaaaaaaaaaataaaaaatccatgggccgtgttttaaaaacgtggtaatgggaaaacccttgggttaacccaattatatcgctttgaaacaaatcccctttttgcaattgggtttattacgaaaagggccctaaccgttgggcctttcacaaattttgcaacctgtaagggtaatgggcaaatttaagggttaatttttgtgtaaaatcccgttaaattttgtgaaaaaccttttttttaaccaatggcgcaaatgggcaatcctttttaaacaaaggattccccgaataggttaggttgtccttttgaaaaaggtccttttaaaacgggcctacactaaaggggaaaactttttagggatggccctttgaacatcccttagtttttgggcgggccctcttagtgaccctaaggcgcccttttaattttgggggccc

SEQ ID NO: 438556 - DNA, 1748 bp, Homo sapiens
gatagctggtcctacattagaagagacgagatggaagccaaaaagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438557 - DNA, 1622 bp, Homo sapiens
ccgtcatgagaagagacgagatgtgagacattcattgtcacggagcgaggagacaaaggcaagttcaagttgagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438558 - DNA, 3100 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtgagtaactcggtgcgttggagggaaaagtgcaggggaacgttaatggccaacaccaactccctcgcttgactatgctaacattttctttcttgtgtaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438559 - DNA, 3089 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggtgaggagggcagacgcccaagctttgttgccgcctgcagactcccttttgggagccctcagctctcatcctgtacctctcacctcacagatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438560 - DNA, 3112 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatactggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438561 - DNA, 2939 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaaggtcctgagtttgtgcgccatatcttcaacaagcatgcagagttgaggaagtgatgcctgagatcgccagcccagacacctgggcccggccagatactactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438562 - DNA, 2465 bp, Homo sapiens
  misc_feature (2437)..(2437): n is a, c, g, or t
  misc_feature (2454)..(2456): n is a, c, g, or t
  misc_feature (2460)..(2460): n is a, c, g, or t
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagccacccgcctcgcncctgccgtggtattttnnntccntcccc

SEQ ID NO: 438563 - DNA, 1211 bp, Homo sapiens
gaaattatcaggtaggtacgaggccgggtggtttggcgtgcagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438564 - DNA, 1486 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438565 - DNA, 713 bp, Homo sapiens
cacatgatttctgatgctatctggtctgtagttttagaagtttcaatagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438566 - DNA, 1204 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaatgataccggaaaggacagaggagactctagagacaacagttgaaatggaggaaaggacagaggagagcgcagaagggacagtagagtcaaac

SEQ ID NO: 438567 - DNA, 1092 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtgttcggtctaagtaccacccagatgcggtggggcacagcgcctcggcaacggcagagcccgcgaggacggccaccagacacaaaccgactgagggatctacacgataccatcatggagagctggacccgcaaccgactacaccataacctccaggaccaccagcacccagagcccgcatgaccccacgcaccaaacaatgacggaccgcacgcccgcggaaccacccatggcacggccggccacggagcaac

SEQ ID NO: 438568 - DNA, 1335 bp, Homo sapiens
ttagacagaggaggagcacagacgaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggggctcctgactctcgtgtgttacataactcctccatccttccagagtaactcctgaggtgttgctcagccctgccacttttattattgatgtcaaaagcgccaggctttgcagggacaccagtgggaggtacataggtgcgtgtctgggacccgagaatctcagttctgtaacttcgtcctcagtccaaggtgcgctgctgctgttgggagctaaggctggtcaagcacaggttgtagaaggagttggggtcaaaggctgcactcacctcttgccagcccacccacccagcagcctgtagttcactggggctttttggagtgccccagtagtgagggtccaataccaggacataggcttccgtgcctgacccgacgcagactcccagcaaggccttggacctggcatctgcgtcccccccaaccatgactgggcccccaccccctgcgaagtgcgagtaaagcctctccagctccccgtgcagccccactccccggggtacgtggcagaggcgtccctggggccctccgaagtgagcgaggcagaggctggcctccacgcagccgatccagtcccgggagccccggaagccggggggcttgtcgcccatgtcctccagggccgcctgtacggcggccagtccaggtacgcccgcgggctggccctctggccacgagcacagcgtctgcagagtgcggtagccgcagccccagccgcggtcgtccaggccgtcgcagccgtagtggtagtagaggtagtggcccgagagcagcgccaggcggacagggccgcggctcggcggggacaggcccacgtggacgtccctcagcggctccagggcggtgggcgggagcggaggtcccaggccaggcacagcgtcctcctagcggcgcggagcgacctcaggctccaacacttcctttcggctccgggtcttgggccagctgccgcaggaccggcgcgcagactggggacgcgctccccgggcctcgttgatcaccgcaggccgcaataggcagccaccg

SEQ ID NO: 438569 - DNA, 1512 bp, Homo sapiens
gtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggtgggggccgcggagggctggccttggcgggagggaagcgggcgagctgcccgcgagggacggtcccttcctccgctcgtccttttgcaccactcctaccgcctctccccggtccccaggccccctcagaccgtgccatgggtgacagtgatgacgagtacgatcgaaggcctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggaaaaaaaaaaaaaaaaaaaataaaaaaaaaaaaaaaaaaaaacaaaaaaaaaaaaaaaaaaaaaaaaaaaataaaaaaaaaaaaaataaaaggataaaaaaaaaaaaaataaaaaatccatgggccgtgttttaaaaacgtggtaatgggaaaacccttgggttaacccaattatatcgctttgaaacaaatcccctttttgcaattgggtttattacgaaaagggccctaaccgttgggcctttcacaaattttgcaacctgtaagggtaatgggcaaatttaagggttaatttttgtgtaaaatcccgttaaattttgtgaaaaaccttttttttaaccaatggcgcaaatgggcaatcctttttaaacaaaggattccccgaataggttaggttgtccttttgaaaaaggtccttttaaaacgggcctacactaaaggggaaaactttttagggatggccctttgaacatcccttagtttttgggcgggccctcttagtgaccctaaggcgcccttttaattttgggggccc

SEQ ID NO: 438570 - DNA, 1094 bp, Homo sapiens
gtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggtgggggccgcggagggctggccttggcgggagggaagcgggcgagctgcccgcgagggacggtcccttcctccgctcgtccttttgcaccactcctaccgcctctccccggtccccaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacaggtgagccgtttttaacttcatcttgtccccgtttcatgccgtttcactccacccgcgtcgcttttctttctcccccttgtaatttttatgagggcgaatcctatgaaatggctcattggaccgttttctgtggttcagcctatttgctgttggccaaataactagctgtggcttggtttttgaaattctctgcagatcagagctatagagctaagagtttgagtatgaagaagcactgtttatacatgcacgaaaagcgtgcttttttgcttttttttgttttgttattgagatggggtttcaccatgttggccagctggtcttgaactcctgacctcacatatcca

SEQ ID NO: 438571 - DNA, 475 bp, Homo sapiens
gattcccggtgtcgacttactagctgcaagctctgcctgccttcctgcgcgccgttactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438572 - DNA, 514 bp, Homo sapiens
ggaactgcttactgcactggcaggcgggagctgggaatccttccagctcgggcctgggagcgaggcaacccttatgtggctgtcctgacccctctcctctctccacccagggtcctgagtttgtgcgcaaacatatcttcaacaagcatgcagagaaaattgaggaagtgaaaaaggaagtcgcgttttttaacaacttcctcactgatgctaagcgcccagctctgcctcttgcaaggccctgagtccactttgaaaggcatgtgggtaaacagatggcaggggagcccgcctatcctgaggctgggagaggatgtctggccaggcgggaacagcgggcatggcccacgggcaccaggcttcctgaaaagctggaaggagacaaaaggcccacatggccttggcctgcagaggaagacatagcggcaacacggctaatcgtgacaaagcatctgttctgtgcctggcagggaagccggcccacagaatacacaatccaaccactgcctcgtgg

SEQ ID NO: 438573 - DNA, 3252 bp, Homo sapiens
gtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438574 - DNA, 3379 bp, Homo sapiens
cgtcagccggtaccgggttactagaagataagagcaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtaaagatcctggaggtgatgcctgcggctttcctttcctcttctgccccactcgtggttctgttctgtcttcgctgtcccctctctcgaattgctctgtgtctttgtcctaatctctcagcaccttcattcttctctgtttctgttcttgctccctgcctaacaccaccttcttccctgttggtttttttagtttctctctctgatctttagtttttccctttgttttcggtttctgggactttctcacactctcccctttcctccctttccccttttcctcatactcctcatttcttctgttttccctctgaggtcctatttgaaatgttttatttttcttctccctaaccttccagccctctcctctctctccccctgtgggcaggacctgaggctctaaagggcactccagtgtctcccttcggtctttcctgtcccttcaccgtcttgcttatcttcccacgggtggagaaaggtgccctgcctctgggcttttgctatctggccctctgtcttccacctcggggtggagggagttggcgggagcagtttttgaatgactgcagtttggggttggtgaggagagggaggttcttcagggcctgctatttcctgagccttcctctctgaagctttggggaaatgacacctttttactacgttagtgtttcccagagatttaaagtggtaaatctgcctctcctaccctggcgtccccctgtagtcattggtcttcccaaatccagagctcttagttcctggttctcccccaaatcttcacagaacacaacttctggttccttttggggtgttgggtggttctagcgcacccctatcccttaatctctctattttgatgaccttttgtggttgtgagaggaagggggatatgccctgtctttcctgggccccttcccacatcctggccttggcttccaataactgttttgtctttccctcccccgcttcgttcccaggtgtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438575 - DNA, 2557 bp, Homo sapiens
ttcggcaacgagggcacggagaatgatctcctcctcctcctcatcctctttctgctcctcctccttgaaaagagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438576 - DNA, 2184 bp, Homo sapiens
agaggatcccctgaacattcgtgtcgtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438577 - DNA, 2330 bp, Homo sapiens
ttcggcaacgagggcacggagaatgatctcctcctcctcctcatcctctttctgctcctcctccttgaaaagagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438578 - DNA, 4024 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggggctcctgactctcgtgtgttacataactcctccatccttccagagtaactcctgaggtgttgctcagccctgccacttttattattgatgtcaaaagcgccaggctttgcagggacaccagtgggaggtacataggtgcgtgtctgggacccgagaatctcagttctgtaacttcgtcctcagtccaaggtgcgctgctgctgttgggagctaaggctggtcaagcacaggttgtagaaggagttggggtcaaaggctgcactcacctcttgccagcccacccacccagcagcctgtagttcactggggctttttggagtgccccagtagtgagggtccaataccaggacataggcttccgtgcctgacccgacgcagactcccagcaaggccttggacctggcatctgcgtcccccccaaccatgactgggcccccaccccctgcgaagtgcgagtaaagcctctccagctccccgtgcagccccactccccggggtacgtggcagaggcgtccctggggccctccgaagtgagcgaggcagaggctggcctccacgcagccgatccagtcccgggagccccggaagccggggggcttgtcgcccatgtcctccagggccgcctgtacggcggccagtccaggtacgcccgcgggctggccctctggccacgagcacagcgtctgcagagtgcggtagccgcagccccagccgcggtcgtccaggccgtcgcagccgtagtggtagtagaggtagtggcccgagagcagcgccaggcggacagggccgcggctcggcggggacaggcccacgtggacgtccctcagcggctccagggcggtgggcgggagcggaggtcccaggccaggcacagcgtcctcctagcggcgcggagcgacctcaggctccaacacttcctttcggctccgggtcttgggccagctgccgcaggaccggcgcgcagactggggacgcgctccccgggcctcgttgatcaccgcaggccgcaataggcagccaccg

SEQ ID NO: 438579 - DNA, 3535 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggaaaaaaaaaaaaaaaaaaaataaaaaaaaaaaaaaaaaaaaacaaaaaaaaaaaaaaaaaaaaaaaaaaaataaaaaaaaaaaaaataaaaggataaaaaaaaaaaaaataaaaaatccatgggccgtgttttaaaaacgtggtaatgggaaaacccttgggttaacccaattatatcgctttgaaacaaatcccctttttgcaattgggtttattacgaaaagggccctaaccgttgggcctttcacaaattttgcaacctgtaagggtaatgggcaaatttaagggttaatttttgtgtaaaatcccgttaaattttgtgaaaaaccttttttttaaccaatggcgcaaatgggcaatcctttttaaacaaaggattccccgaataggttaggttgtccttttgaaaaaggtccttttaaaacgggcctacactaaaggggaaaactttttagggatggccctttgaacatcccttagtttttgggcgggccctcttagtgaccctaaggcgcccttttaattttgggggccc

SEQ ID NO: 438580 - DNA, 3306 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtgtgagtgctgggggtgggactgtggggaagaggaagggagactctgtgccacacgggacctctgtgtgactttgttcatctgatagtttggttgttctgcacactctttgaccgttttgtctgggctacgttgtctctgggcaaggctctagggcgttacatgggacggaacctatgtggtccccgtccccagggagctcgcagtctgatcaatcgctggtgctcaagagggaagggtcttagagctgctgtttctctggcaagcggggtaagtggggtaagctgctgatgatgtctgccctccagctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438581 - DNA, 3201 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatactggtgctgtccgccctgcagtccccacaggaggccctccatacccccatgccccgtatggtgctggtcgagggaactatgatgccttccgaggccagggaggttatcctgggaaacctcgcaacaggtgaggagggcagacgcccaagctttgttgccgcctgcagactcccttttgggagccctcagctctcatcctgtacctctcacctcacagatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438582 - DNA, 2735 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtcgcactgcagtccccacaggagggcttaggatatatgagcacg

SEQ ID NO: 438583 - DNA, 2812 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaaggtcctgagtttgtgcgccatatcttcaacaagcatgcagagttgaggaagtgatgcctgagatcgccagcccagacacctgggcccggccagatactactccccccaggtttgaccccaggactcccctacccacaccagactccccagggcctgatgccctatggtcagccccggcccccgatcttgggctatggaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438584 - DNA, 1806 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctcctttggaggtttttccgctgtggttgggtgactttcaaccgcagtgttaacattatagagatcctgtgagaccttcagaacattcctttccgggcgtgggaggtgcacctctggggtgtaccggtatctgaaccggtgccgtttgaacataaaccgcactaccccagtcaagttgtttggtgcgaaccaattaaagctggcggccaatctggtacccctctggactccacccttct

SEQ ID NO: 438585 - DNA, 1374 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagggtgaggtgtctgtggcctggggtcagagtgttggggctggggttctggcacgctgacttgtcccctctgctgtggctc

SEQ ID NO: 438586 - DNA, 996 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtgagtgcccctacttccctggacctctgccctggcatgtccccctggccccgctggtggagccacagccctgtcctcttcccagttttccctgtccagaactttctgggggcgggggtcgggaagtatgacagcattggctgatggggtctccc

SEQ ID NO: 438587 - DNA, 977 bp, Homo sapiens
gtagttcctaacgctcgagccgttatcgtctcgaaaagccgcgcgagacttgcgagatccccgcccctttcccatcacgccctgctctccccgcccttcgcgctcggtttgttagttccagttccggccgcgagggtggagctttgtgcctcggaggcgtgggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggtgggggaggggaggagcctggggggccccgctggggcgggagaggaaccggggtccacgggggcgggcgcggagaaactcggggcgagtggaggtgttggagccgcgttctcaggcctaggatggtgggggccgcggagggctggccttggcgggagggaagcgggcgagctgcccgcgagggacggtcccttcctccgctcgtccttttgcaccactcctaccgcctctccccggtccccaggccccctcagaccgtgccatgggtgacagtgatgacgagtacgatcgaaggcctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 438588 - DNA, 697 bp, Homo sapiens
tatatgctaggtacgaggctgggctgaaatcggccgaggcgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactggtgagatggagcggtttccctctcctcccctttgcctcagttccacctgggcctcccctttctcccctcacctgtgcctaaatctttgtcatttccttttctcaacttcccatcacccatcgttactttgtcccttgaaacccttgtctgggagaccatgctgtgtgtacccccgtctgtccatcctccatg

SEQ ID NO: 438589 - DNA, 367 bp, Homo sapiens
ggccagtgctggcaagggggttccttggcagcagctgacaggagggaaggttgcccggtcaggggctccaaatacaggcaggggtttttgcaaagccggggcagcgacatggcaatcgtgatgccataggaagccgaagcctgcaaagggcacagctgggtggacgcagcacctgcggccagagactggtggctgagcatgggggtgcctggcatggaaacttgcagggcttggagctgatggttaggggagggagtcaccaatatcacctctgctcctcctggcagtccccctgctgtgctatcaaatattaggtctttatactagatctttttttattaaaaaaattttttttaaagatggagtc

SEQ ID NO: 438590 - DNA, 2021 bp, Homo sapiens
  misc_feature (1403)..(1403): n is a, c, g, or t
tttccctggaaaaacaatgatttgaattcaaggaggggaggagaacaggtttcccccaactccaagcttgaggactttcttttccttttgaagtaggaatggagttctgtccccggcccccgaaggcgtccttacagctgatatttttccagctgcctatctccccagagcgtggagcggcctccagagtggggtcagggatggggcgagagggccagacctgcctgggccgggcagctcagcatctctctgagctgctgaacacctatggaggctgtgctcatgttcactggtggtgtgactttgtgtgaccttgccacttcactctttcacagcctcgtttcctttatctgtcaaatggggatcatgagtccactgggtggcttttgaagaacgtgccacaatcagagaaggtctgagctgggaaatgcaacagaggccttctcctccttgaccagtggggaaacagaggctcttaaaactggcatagatccagcttcctgcccctagtctctgtctttcccattccatcaggaccagatctcagaataggggattggcattttcatgctggggagctgggtatcattttcttttcagagacttagtagaaaataaaaggatccctgagaaattctttatgtgcaggtgcttgtcgatggtaggggtgacctcaggaccgcactgtctgcccatgaccaaggagtgagactgcttggacattgtccttgtgtcccccctgggggtctggatcaaagcccaccctgaaggtgacaacactaacctacagatgtttgttctctctcatgccctccaggggtttcctggagtctttggggaaagaggccctcctggactggatggaaatcctgtgagtatttcaagtctttgggaacaggagcgagattctgagtgaacacacagcagattttaggagcccacgctttagggtcagacagacctgggtcaaatcccagccctgtgaagtaccagctgggcacccttggacaaattacatgacgtctctaaacgctaggctcctgtctactgcggctgcaccgtcgcccccctgtaagagtccccagcccactgagcccctgggtccaaagctccaggctgcaccccatttccaggactttggaaggttcatgggtcactccccactggagaggccccagctgctgccatcttacacagcatcagcaatgtttatgggccggcagaggcatggggaagcaaacggtctgcaggccgtgtttggagaaaaggaagagctgagttccaaaggaatctccaccacaggcatgtttatagagtttgtaaataattagaggcccaggctctgttccccgaggagccaggtcagcctgccctggggagccgagtctgtctttcccttcccngctccaggccctggtgggagaaggtgttcatggttccccatctccccctggggcttcctgcctgagcagctgtgccagctgtgccctctgcagtggtggctgctgcgttcataaccagcacccgattaggcgctaattcagttccacaaatgctccctgagcctgacccagccaggctcccttggggattatagccttgacctcagaaccctgcggacctgggtttgaattttgttgtaccacttgtcaggtgtgtgagcttggaaaaatccattcacctccctgaatctcagtttccttgtctgcaaattggggggatcagaattccagcctgaggccgggcgcagtggctcacgtctgtaatcccagcactttgggaggccgaggcggctagatcacttgaggccaggagttcaagaccaccctggccaacatggcaaaaccccgtctctactaaaaatacaaaaaattagctgggcgtggtggcaggcatctgtaatcccaggtacttgggaggctgatgggggagaattgcttgaacccgggaggtggaggttgcagtgagccaagatcacgccactacactccagcctgggcaagagagtgagactctgtctc

SEQ ID NO: 438591 - DNA, 1196 bp, Homo sapiens
gtaagccaaggccccctcagagggaatgggtgactagagtcatgtctgcctgaggttctgtccaagtacccctttgactctgcccatttgttgggggtctccaaggccacacactggagataagatccctggttcatccccactaatggcagctaaggccagcaggcctgggacttccccaggaggtctagactttcatctcccatcccaatccatcctcctctttgtctctttgcagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacaccctggggcctcctgaaagcttaacctcttggctccaaggtggagaggtgttcatctcctccactcctttaaatatggagctcattcctggaaggggcttcctcaatccggaaggactgatgctggggatggccatagaggaatttggccgcaccacgaaaccccgtcagtggcgtgagagtcacacacgatgggcttcctcaccaggcctgcaacatctgttgggggaagaaaggaattaaaacagggggaggcctggatttttgaaatctttccagtgtcattcgagcgcattctgtgggaagcccgggagtttggaaaggctgccgcggcctggatatatttcctgattgg

SEQ ID NO: 438592 - DNA, 900 bp, Homo sapiens
ttggtactggggcgttgccagagtccttctcatcagtatctggatggcctatccctccctggaataggagctggggccggtgggagaagggaaacaactatttgggttaataaatgtggtcaaggcgtgtgatgggggctttatgagaaggggcaggtcttgaaaggggagggaatcccagcatcccgtgtgacgtggtggctcagcacagtccagacctcaagtcctactcagtttactcctccattgacaaatcctagccctgagagacggtctcgccttctctcttgattcagaaggaatggttgcgatacaccatctcttggtcacagttgctctgtcccagttcagctcacctactctgccagagcagtgaatgaccctcctgatgtcctctggcctaagaaccactgggagcagagagaaaaccttaggaatatgtgaaccctcacatggtatctgcatccatctggggaacctttactgagtgcacactccatcccggatgcagtacatacggtgctgaacagggcaggccgggaggctgggcccttgcgatctccaggaccagatgtgtcctccctgcctgatgcagcttcttccccctccaacagggacacaagggctatcctggaccggcagggcaccccggagaacaggggcagccaggacctgagggcagcccaggggccaaaggttaccctggcaggcaggtacctggaccggtaggagatccggccccaaggagcagggtacatgcgctccaggctctcggctgcaggccgatgaaaagagcgcctgcgtcgcagaggcaaaggtccaccaaatcgagcaagggacccagctcgaaggccggtgacacggcccacggatccgatagggcggggaaaggccggacac

SEQ ID NO: 438593 - DNA, 590 bp, Homo sapiens
acactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaat

SEQ ID NO: 438594 - DNA, 2934 bp, Homo sapiens
tgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438595 - DNA, 4047 bp, Homo sapiens
  misc_feature (1577)..(1577): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccacgccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgcttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438596 - DNA, 7171 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
  misc_feature (3660)..(3660): n is a, c, g, or t
  misc_feature (4662)..(4662): n is a, c, g, or t
  misc_feature (4664)..(4664): n is a, c, g, or t
  misc_feature (4667)..(4667): n is a, c, g, or t
  misc_feature (4669)..(4669): n is a, c, g, or t
  misc_feature (4672)..(4672): n is a, c, g, or t
  misc_feature (4674)..(4674): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438597 - DNA, 5791 bp, Homo sapiens
  misc_feature (2233)..(2233): n is a, c, g, or t
  misc_feature (3235)..(3235): n is a, c, g, or t
  misc_feature (3237)..(3237): n is a, c, g, or t
  misc_feature (3240)..(3240): n is a, c, g, or t
  misc_feature (3242)..(3242): n is a, c, g, or t
  misc_feature (3245)..(3245): n is a, c, g, or t
  misc_feature (3247)..(3247): n is a, c, g, or t
tttccctggaaaaacaatgatttgaattcaaggaggggaggagaacaggtttcccccaactccaagcttgaggactttcttttccttttgaagtaggaatggagttctgtccccggcccccgaaggcgtccttacagctgatatttttccagctgcctatctccccagagcgtggagcggcctccagagtggggtcagggatggggcgagagggccagacctgcctgggccgggcagctcagcatctctctgagctgctgaacacctatggaggctgtgctcatgttcactggtggtgtgactttgtgtgaccttgccacttcactctttcacagcctcgtttcctttatctgtcaaatggggatcatgagtccactgggtggcttttgaagaacgtgccacaatcagagaaggtctgagctgggaaatgcaacagaggccttctcctccttgaccagtggggaaacagaggctcttaaaactggcatagatccagcttcctgcccctagtctctgtctttcccattccatcaggaccagatctcagaataggggattggcattttcatgctggggagctgggtatcattttcttttcagagacttagtagaaaataaaaggatccctgagaaattctttatgtgcaggtgcttgtcgatggtaggggtgacctcaggaccgcactgtctgcccatgaccaaggagtgagactgcttggacattgtccttgtgtcccccctgggggtctggatcaaagcccaccctgaaggtgacaacactaacctacagatgtttgttctctctcatgccctccaggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438598 - DNA, 7129 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
  misc_feature (3660)..(3660): n is a, c, g, or t
  misc_feature (4662)..(4662): n is a, c, g, or t
  misc_feature (4664)..(4664): n is a, c, g, or t
  misc_feature (4667)..(4667): n is a, c, g, or t
  misc_feature (4669)..(4669): n is a, c, g, or t
  misc_feature (4672)..(4672): n is a, c, g, or t
  misc_feature (4674)..(4674): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttggttttctgaaaagggatccagcacacctcctcggtttttttttcaataaaagtttagaaagaaaaaaaaaaaaaaaaaaaaaaaaaaaaaaaaaaaaaaaaaaaaaaaaaaaaaaaaaaaaaaaaaaaaaagaagagggacgaggacacacactgaggaacctcaccacagagggctgcccaacacggcgcgcgcacccaaccctcactattctgatcacacccatgatggtgccaccacattgtgcgcggactccataactaaacaagccagactccgcgacgccgctccgtgaattcaaccgacacccatcaacggcagggaaaaaaagagggccacgaggcgcggaccatttcgggagaggaacagcactcctacaataccccgcgggctgggtcggacaacaaccgtgcagggcacaccaacgcgcgcacaagcagagaatttatcagccacgcatcggcgcacacctcccagaacgtaccccaaccagatacaccgtggcgaacaacacgagcgcgaaaaaccgagcgccgtctacacacaaatgtgcaacccagcggcctac

SEQ ID NO: 438599 - DNA, 1443 bp, Homo sapiens
gcacgagctcgtgccgaattcggcacgaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438600 - DNA, 2954 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2030)..(2030): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggtccttctaccccaaagttcagaggccagaggtgggaactcaatgccttcagaaggtgccctggctggacgccatggctcacacctgtaatcccaacactttgggaggccaaggcaggcagatcgcttgagcccaggagttcgagaccagcttgggcaacatggagaaaccccatctttaccaaaaatacaaaaattagccaggtgtagtggtgtgcatctgtaatcccagctacttgggaggctgaggcggcaggatcactaggaggcagaggttgcagtgagcagttatcacaccactgcacttcagcctggatgacagagtgagaccctgtatcatgaaaaaaaaagaaggatcccctggacacagcccacctggctgattcttgtcccaggaggtgagacgatctaccttcagcatgaccaagaagagctggtttaggtgagactggaatttaccaggggagaccctaaagatgtgggggaggaagcttgggtaaggtcagatatgcccccacaaagacatgatctggaaacacacacacaccctcccctgccacactcctctgccaccctctgcaaccagttggacacgcgtttgagcagcttctacataccaggctttgcccgtgcatagctcatatgaacatgccaaactccagaggtggacctgggctctgcttgctttatgaccttggccatgtgatgttgcctaaccgagtctcaattttcccatctgtgaaatgggactgataacttttccctcaaagatagatatcaaatgcaaaatgaagtcttgcatgcaaagtg

SEQ ID NO: 438601 - DNA, 3807 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacagctctgagggatgggcagagggacagcttcaatccttcctgcccagccctggggcctcctgaaagcttaacctcttggctccaaggtggagaggtgttcatctcctccactcctttaaatatggagctcattcctggaaggggcttcctcaatccggaaggactgatgctggggatggccatagaggaatttggccgcaccacgaaaccccgtcagtggcgtgagagtcacacacgatgggcttcctcaccaggcctgcaacatctgttgggggaagaaaggaattaaaacagggggaggcctggatttttgaaatctttccagtgtcattcgagcgcattctgtgggaagcccgggagtttggaaaggctgccgcggcctggatatatttcctgattgg

SEQ ID NO: 438602 - DNA, 3761 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacaccctggggcctcctgaaagcttaacctcttggctccaaggtggagaggtgttcatctcctccactcctttaaatatggagctcattcctggaaggggcttcctcaatccggaaggactgatgctggggatggccatagaggaatttggccgcaccacgaaaccccgtcagtggcgtgagagtcacacacgatgggcttcctcaccaggcctgcaacatctgttgggggaagaaaggaattaaaacagggggaggcctggatttttgaaatctttccagtgtcattcgagcgcattctgtgggaagcccgggagtttggaaaggctgccgcggcctggatatatttcctgattgg

SEQ ID NO: 438603 - DNA, 7272 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
  misc_feature (3660)..(3660): n is a, c, g, or t
  misc_feature (4662)..(4662): n is a, c, g, or t
  misc_feature (4664)..(4664): n is a, c, g, or t
  misc_feature (4667)..(4667): n is a, c, g, or t
  misc_feature (4669)..(4669): n is a, c, g, or t
  misc_feature (4672)..(4672): n is a, c, g, or t
  misc_feature (4674)..(4674): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438604 - DNA, 5135 bp, Homo sapiens
  misc_feature (1577)..(1577): n is a, c, g, or t
  misc_feature (2579)..(2579): n is a, c, g, or t
  misc_feature (2581)..(2581): n is a, c, g, or t
  misc_feature (2584)..(2584): n is a, c, g, or t
  misc_feature (2586)..(2586): n is a, c, g, or t
  misc_feature (2589)..(2589): n is a, c, g, or t
  misc_feature (2591)..(2591): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccacgccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438605 - DNA, 7219 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
  misc_feature (3660)..(3660): n is a, c, g, or t
  misc_feature (4662)..(4662): n is a, c, g, or t
  misc_feature (4664)..(4664): n is a, c, g, or t
  misc_feature (4667)..(4667): n is a, c, g, or t
  misc_feature (4669)..(4669): n is a, c, g, or t
  misc_feature (4672)..(4672): n is a, c, g, or t
  misc_feature (4674)..(4674): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggtttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438606 - DNA, 5078 bp, Homo sapiens
  misc_feature (1577)..(1577): n is a, c, g, or t
  misc_feature (2579)..(2579): n is a, c, g, or t
  misc_feature (2581)..(2581): n is a, c, g, or t
  misc_feature (2584)..(2584): n is a, c, g, or t
  misc_feature (2586)..(2586): n is a, c, g, or t
  misc_feature (2589)..(2589): n is a, c, g, or t
  misc_feature (2591)..(2591): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccacgccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaagaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaacatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438607 - DNA, 6491 bp, Homo sapiens
  misc_feature (1541)..(1541): n is a, c, g, or t
  misc_feature (1762)..(1762): n is a, c, g, or t
  misc_feature (1833)..(1833): n is a, c, g, or t
  misc_feature (2129)..(2129): n is a, c, g, or t
  misc_feature (3660)..(3660): n is a, c, g, or t
  misc_feature (4662)..(4662): n is a, c, g, or t
  misc_feature (4664)..(4664): n is a, c, g, or t
  misc_feature (4667)..(4667): n is a, c, g, or t
  misc_feature (4669)..(4669): n is a, c, g, or t
  misc_feature (4672)..(4672): n is a, c, g, or t
  misc_feature (4674)..(4674): n is a, c, g, or t
gcttgaaagaatgacatttgaggccaggctcaagactgcagtcccagcgctttgggaggccgagatgtggacatcctccagcggctgggcctcagctggacgaaggccgggagccctgcacccccgggagtcattcctttccagtcgggcttcatctttacgcagcgggcccggctccaggctcccacgggcaccatcattcctgccgccttgggcacagagctggcactggtgctgagcctctgctcccaccgggtgaaccatgccttcctcttcgctgtccgcagccggaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccantggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgntcttccacctggcaggatctacgcctttccctctgctgatggggcctccgggacccaagggagactgtggnttgccgggtccccctgggctacctgggctacctggaatccctggtgcacgtgggcctcggggtcctcctgggccttatggaaatccaggtctccccggccctcctggagccaaaggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccgnccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatggtaaggaggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctancaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactgggnantgnanggncngggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcatggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctgccgaccaaagagaccattgagcaggaaaagcggagtgaaatttcctaaaatcctggaggatttcctacccccgtcctcttcgagaccccagtcgtgatgtggaggaagagccacctgcaagatggacacgagccacaagc

SEQ ID NO: 438608 - DNA, 767 bp, Homo sapiens
cagaacacttgcctgatacgatcgagctcgtacccctagtggaaagcgagtgggtcagtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgaca

SEQ ID NO: 438609 - DNA, 457 bp, Homo sapiens
aatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgac

SEQ ID NO: 438610 - DNA, 2638 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438611 - DNA, 2143 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438612 - DNA, 2703 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagagagagtgtgcctattgactgtggggtgtgtgagttgaaccccagtactgacagcctccttaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438613 - DNA, 2534 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438614 - DNA, 2567 bp, Homo sapiens
agcattgtgggattggatgagtctcaagatggacaaccgggatgttgcaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagaaattaggctgttgggtgtggtgagttgagcccagtactgacagcctgcttaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438615 - DNA, 1605 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttaccccaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438616 - DNA, 1682 bp, Homo sapiens
gcaacggatgattctagaggatcccgaacgggtgatgcgtttgctgcacagtcgcacgtgtggggctgggtgcttgctagtgtgggccggatgctgttccaagcgttttctgattctcaccagaagtgacaagtggctcccatgtggcacggagacttgctttcgggtccctgctcgccagcctgcctttttttgcacgatagaagctgcagggatatgcctgtcacagatacttattttcccctctcttctgcaaacttcctcctctccagatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438617 - DNA, 1402 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtggggccttcacaaaaaccttttcaataccgcctccaaaaaaaagaccaattttgtaaaggaagccaagccatgggaagaatgtccagccca

SEQ ID NO: 438618 - DNA, 1112 bp, Homo sapiens
taggctagtacgaggctgggtgttaatcggccgaggcggctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438619 - DNA, 1664 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaaggctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438620 - DNA, 1653 bp, Homo sapiens
ccacgcgtccgctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaaggctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438621 - DNA, 1530 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccaccaaaagatgcctggtcctgttgcaggaagcccctcctgttagcagcgggatgcaagatgctgtctcggggctctccttattggcctgtggagtctccatccccgctcagcctgggttgcactggaggggaggaagaaagctgttttcagcatagtaaagctggaaggccaggtgcagtgtctcacccctgtcatcccagcactttgagaggccaaggcgggcggatcactggaggtcaggagtttaagaccagcctggccaacatggtgaaatcctgtctctactaaaaatataaaattagctgggcatggtggtgcacacctgtcgtctcagctactcgggaggcagaggcaggagaatggcttgaacctgggaagcggttgcagtgagccaagattgcgcctttgcactccagcctgggcaagagagcaagactctgtctcaaataataataataataataaagctggagacttggccacacctgggctaaagg

SEQ ID NO: 438622 - DNA, 638 bp, Homo sapiens
gcaattctcctgccccagcctcccgagtagctgggattacaggtgggcgcccccacgcccagctaatttttgtatttttagtagagacggggtttcaccatgttggccaggctggtctcgagctcctgaccttgtgatccgcccacctcagcctcccaaagtgctgggattactggcgtgagccaccacacccagcctctttcagctgttttcttaaagcacacagcaacctacacattcttttgtgataccaggccactgtaagggtggagcagcatgtgactttggtgttattgagatcatccgtgaccattgcagaaaaccactcccatctgtgcagtgagcaccttgaaataggccgtccaggaggcagagggtgcaccttgaaattgtgctaggctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438623 - DNA, 363 bp, Homo sapiens
acttcgcagtagtctcttgaaatctctgggggccagtttggggtcccagtaggtgagagtgctggggtgagttaggggccatgatggacgaggtgatggcctcatcctcatcctcgtcctctggtgccctcactccatctctagccagctcaccctctctgtcctctgtcttggttctagaatcacaaatgcacacaactcttcctgcatttccaacaagtttgccaacgatggtagcttcttgcagcagtttctgaagttgcagaaggcacagaccagcacaggtgagtgtaggcctcccctttccttgtgctgtccttgcatctccccctggggttgctgggcacatgggaagtgatgggt

SEQ ID NO: 438624 - DNA, 325 bp, Homo sapiens
aagggaaggctgtgctgttgaatgcgtttgctgcacagtcgcacgtgtggggctgggtgcttgctagtgtgggccggatgctgttccaagcgttttctgattctcaccagaagtgacaagtggctcccatgtggcacggagacttgctttcgggtccctgctcgccagcctgcctttttttgcacgatagaagctgcagggatatgcctgtcacagatacttattttcccctctcttctgcaaacttcctcctctccagatttttgcacgataagaatagcagggaattcctctactacaggaagaaggtggctgagataagaaa

SEQ ID NO: 438625 - DNA, 2088 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438626 - DNA, 2077 bp, Homo sapiens
ccacgcgtccgctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438627 - DNA, 2017 bp, Homo sapiens
agcattgtgggattggatgagtctcaagatggacaaccgggatgttgcaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438628 - DNA, 1481 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttaccccaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438629 - DNA, 1590 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagtttcacccccagagggagccgagactcggaaagtgatagagaaattggcccgctttgtggcagaaggaggccccgagttagaaaaagtagctatggaggactacaaggataacccagcatttgcatttttgcacgataagaatagcagggaattcctctactacaggaagaaggtggctgagataagaaaggaagcacagaagtcgcaggcagcctctcagaaagtttcacccccagaggacgaagaggtcaagaaccttgcagaaaagttggccaggttcatagcggacgggggtcccgaggtggaaaccattgccctccagaacaaccgtgagaaccaggcattcagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaaccaacctggcgggcgcccatgggaagaatgggattaaagaaccaagggaaattggggccccaagccaagctttgaacaaa

SEQ ID NO: 438630 - DNA, 1174 bp, Homo sapiens
gatgggcggatcatgaagatcagtgagatagggcaatatgggtgcagcccctatctctacgaggaaatacaaagtgcagcttcacagcacctgatcccggcctgaagcgcaagtcccctcctgaggccctgtcagggtccttacccccagccaccacctgccccgcctcgtccacgcctgcgcccactatcatccctgctccagctgcccccgggaagccagcctccgcagccaccgtgaagaggaagcggaagagccggtgggggcctgaagaggataaggtagagctcccacctgctgaactggtgcagagggacgtggatgcctctccctcgcctctgtcagttcaggacctcaaggggctcggctatgagaaggggaagcctgtgggtctagtgggcgtcacagagctttcagacgcccagaagaagcagctgaaggagcagcaggagatgcagcagatgtacgacatgatcatgcagcacaagcgggccatgcaggacatgcagctgctgtgggagaaggcagtccaacagcaccagcacggctatgacagtgatgaggaggtggacagcgagctgggcacctgggagcaccagctgcggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438631 - DNA, 1357 bp, Homo sapiens
agcattgtgggattggatgagtctcaagatggacaaccgggatgttgcaggaaaggctaaccggtggtttggggttgctccccctaaatctggaaaaatgaacatgaacatccttcaccaggaagagctcatcgctcagaagaaacgggaaattgaagccaaaatggaacagaaagccaagcagaatcaggtggccagccctcagcccccacatcctggcgaaatcacaaatgcacacaactcttcctgcatttccaacaagtttgccaacgatggtagcttcttgcagcagtttctgaagttgcagaaggcacagaccagcacagacgccccgaccagtgcgcccagcgcccctcccagcacacccacccccagcgctgggaagaggtccctgctcatcagcaggcggacaggcctggggctggccagcctgccgggccctgtgaagagctactcccacgccaagcagctgcccgtggcgcaccgcccgagtgtcttccagtcccctgacgaggacgaggaggaggactatgagcagtggctggagatcaaagatttttgcacgataagaatagcagggaattcctctactacaggaagaaggtggctgagataagaaaggaagcacagaagtcgcaggcagcctctcagaaagctttctgtatgagcccaatagccaagggtacaagtactaccgacagaagctggaggagttccggaaagccaaggccagctccacaggcagcttcacagcacctgatcccggcctgaagcgcaagtcccctcctgaggccctgtcagggtccttaccccaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438632 - DNA, 584 bp, Homo sapiens
ccccgtcccagaaggcgcatggagatggataagaccagggaatgggccgagcagctgacaaagatgggccggggcaagcacttcatcggagacttcctgcctccagacgagctggaaaagtttatggagaccttcaaggccctgaaggagggccgtgagcctgactactcagagtacaaggagttcaagctgactgtggagaacatcggctaccagatgctgatgaagatgggctggaaggagggcgaggggctgggctcagagggccagggcatcaagaacccagtgaacaagggcaccaccacagtggacggcgctggcttcggcattgaccggccggcggagctctccaaggaggacgacgagtatgaggcgttccgcaagaggatgatgctggcctaccgcttccggcccaaccccctgaacaatcccagacggccttactactgagtgttctggaaatacatactttctgaatgaccaaccgtccctggactgtggaatgttccggcctgcatttctgcccaccccttccgttgtcacgagtgccgtgccgtgtaataaagtcccagtgctcatccacc

SEQ ID NO: 438633 - DNA, 821 bp, Homo sapiens
attcctttcaattttaggtaaaagaaacctttttaccagatagtgacgagtggctaccatgattaataagtgactagacctcatggtcctcctcatactaaaaggtgaacagtgcaagctgtcggtggatctaccattctggggtcttggggacagtggccctcttctcacagctcccggtgaatgctgcaatgatcattggtaggactgttaggctttgtttctcaagaggataatctgattgggaaaagaataagagtgcagctgcagcccatccttgtgaagaaggtaccagtgcgctctcaaagccaagtcttgaaaataatagcgaatgctgtattggataacagccatgccagatacagagaagccacagatggcattgtcaccagaaaatggaagcacaaagcgctttgggtaacagcaattcaagaatgactgcagagaaaatctattaagaaattcaaatgcagatttcaatatttactccttttcattctcttcctctctctctcgctcacttgctctttttctctctcccaccttgtttttctcgctctccttttttttgcatacagtttctcagtaaaatacatttgattaaattttataacaaacaagcttatgaaatgcagatatacaaaaaggaaaacataagaagcatgcataattctaccactgaaaaatactactaaaatttggtatttaaacttttgaatgtttgtcactgcacttgcatgtgtgtgtaaatataatctccaactctgcagagaaatacaagaattgttatgaaccttaataaactcccaaaagatttcaaa

SEQ ID NO: 438634 - DNA, 723 bp, Homo sapiens
ttaagaaagctaaatataaacttttattacatcccaatgcaagatgtttccaatacaatctatttccttcaaaggtggggtggagaatgaggggtggggtttgggccacatatttttatgtttacattttatttcagattggaaaatttgtatttcactgtcaaatcaagtaagaacacatttattacttagtgttgcttgaaataatatctacaatgtttaaagtttcatttaaaagcataaacttcttttaagctcaaagttaaaaacacaaatataaactgcatttcatgttctgttaatatttagctgtgtggcaatggatgagtattttttctctgtgaggctttgttttctcatctggcaaatgaggaaattgatgcagatcatcttcaagttcccttcatgatatttaatataactatttatgtcatgcttgtaaatagtaggtgatgatgaaggttactgttccccacaggtgaatgctgcaatgatcattggtaggactgttaggctttgtttctcaagaggataatctgattgggaaaagaataagagtgcagctgcagcccatccttgtgaagaaggtaccagtgcgctctcaaagccaagtcttgaaaataatagcgaatgctgtattggataacagccatgccaggtgattcatagatttatcttatttaatcatggtaagaagcttccaaaagagtttctttgaactga

SEQ ID NO: 438635 - DNA, 883 bp, Homo sapiens
  misc_feature (757)..(757): n is a, c, g, or t
  misc_feature (759)..(759): n is a, c, g, or t
  misc_feature (763)..(763): n is a, c, g, or t
  misc_feature (854)..(854): n is a, c, g, or t
  misc_feature (882)..(883): n is a, c, g, or t
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagagacttnanaccngaggaatattttgcctagaattcaacaaggggacacaatttgcccttaactgggactttcgggactcccggcaaagggggaaacaattggnaccaacaaacagggacaaacaatccaann

SEQ ID NO: 438636 - DNA, 2400 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438637 - DNA, 2790 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtggtgagtatctgtctctcttctaagtatagagaagcccaaagggcatttattttaattcagaattgtctgggggagggttggaaggaatacattggcagatgttttctccataaacctgttattttacctacataaaaagcacatttttgtgtcccaacaaggctcccataatttttagacacatttatcaattcgaagcaccaaaaggcaacaagtgaacattattcttatgtttaactgtgtgtagccttttgagattttgtgcttgaagtgggtgattatggaagttgatataagacttaaacttggtatttaaagcctggtcaagatttccctgtcctgtgtctagtgtgagttcttgacaagagtgtttttcccttcccgtcacagagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438638 - DNA, 2843 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcgtgagtgatgttttcctgtcctcctgggccggccgggacgtgcactagacctccctgcccttattgaatgcacctgtctaaattaatcttgggtttcttatcaacagatggagattaagagtcatgtcttcttctccttaattaactgggatgatctcattaataagaagattactcccccttttaacccaaatgtggtgagtatctgtctctcttctaagtatagagaagcccaaagggcatttattttaattcagaattgtctgggggagggttggaaggaatacattggcagatgttttctccataaacctgttattttacctacataaaaagcacatttttgtgtcccaacaaggctcccataatttttagacacatttatcaattcgaagcaccattttgtgcttgaagtgggtgattatggaagttgatataagacttaaacttggtatttaaagcctggtcaagatttccctgtcctgtgtctagtgtgagttcttgacaagagtgtttttcccttcccgtcacagagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438639 - DNA, 2533 bp, Homo sapiens
ccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactggctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438640 - DNA, 2750 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacagtaagtttgaccggatttgaggaaataactagtatagtttgaatttgccagcggtaaacattctcatcacggcgtttatcgggaaggcgaagacttcttctggggtggggatctcatttctccttaaattctaatatatttgacacattttaaacattaaagttaatttgctgatttggcttgaactggagatgtaagataaatgccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438641 - DNA, 2346 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438642 - DNA, 2648 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagaggtgagcaggggggatagaagtcaactcttagtgtctctgcacagcctgctttgttttagtttgagaaaaaagttttcaaagatttttggtggggagaatgttaccagaattagcatttccttcaacctgtcaggtttatagttaatagattacttggggccacttcctgcagttgttcttttgctgtgtatgtcaaaactaattaaattcatttgcaacccagaatgactttgttctgtctcctgcagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438643 - DNA, 2006 bp, Homo sapiens
tgatttttttaaattgaaatttcaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438644 - DNA, 2447 bp, Homo sapiens
ttaatggggtttattattttccttaactgactaatgtattggggtattttcagtttaaacagtgaattatccgggtagaagtcggtagagccagaaactcacttttgatgttggtgtgcccctagtggcgagctggattctaaatcgtgccctttattccctgcagccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggtatgagatgtgcttgatggggctggcattggcggtagacactccttgaataatcttgattctggaatgttggtgccaagttgaaacatgccactaaatctgaatcgtcattttcctaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438645 - DNA, 1586 bp, Homo sapiens
agaggagaggggggagaggcagggcaacccataggctaggtaacgaggcccgggtggttatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438646 - DNA, 2327 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtatataaccatgttaattacagtacattaaaatggtggtttacattacaaataagcctgtaagtttaaatatactagtgttataacccaatgtacagacgttctttatacaatacatagtcgacgcgg

SEQ ID NO: 438647 - DNA, 2344 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttgttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438648 - DNA, 1040 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagaacttaaagaccaggaggaatatcttggctagacttcacagggacgacatgggtcctttactgagcttccggacctctgcaagggagaaacagtctgaagcagcaaacaagcagcaaccattccagccgttcgtgtggggcacggccggaagtaatctcggcagccctgaagggttggcttttcacttaaaggcaaggccctttactgaaccagggaaccttgttggaacgtggggtggggttggcccttggggcaaggcctggtgcctttgggcttacttggacaggaa

SEQ ID NO: 438649 - DNA, 478 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggtaatttcaaatctgaagatcttttggtacacttccttcatgtcctcttttgtattctc

SEQ ID NO: 438650 - DNA, 274 bp, Homo sapiens
taatatttttcaaggttttattgcaaaccaaaatcagtttatcacacacaaaaaaagttgtgtgatgggatgagggaaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438651 - DNA, 764 bp, Homo sapiens
gctcgtttctatgctgctgaaatagccagtgccttgggctacctgcattcactgaacatcgtttatagggtaagcctgagagctcttcaggctaccagttttggtataaaggagacgtagcactggctgtttcatagggccttaaaataatttgtgtttatttgcaacttggttgcctaaaaccagatcccctagcacgtgagctggcttgacttaagtgccaagggggaaccagccaagtaggattgtgcctaatccagaatagatgagcagaacaagggctcccttttttcttcactacacaactacagtgaacctaaaatgcctctaatacctttagcaattatctttaagaggatatcttatgaagtgaaattaacttgtgcaactacttttctattcacttttttacagagacttaaaaccagagaatattttgctagattcacagggacacattgtccttactgacttcggactctgcaaggagaacattgaacacaacagcacaacatccaccttctgtggcacgccggaggtaggcgctgtcttggtttggtgcctggtttacccccgccttccaagagagagatgtacaatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaa

SEQ ID NO: 438652 - DNA, 591 bp, Homo sapiens
agacttcttctggggtggggatctcatttctccttaaattctaatatatttgacacattttaaacattaaagttaatttgctgatttggcttgaactggagatgtaagataaatggttcgtgttggccgaattcacggcctttctccatgagcaacaatccttatttctgtatttaatggggtttattattttccttaactgactaatgtattggggtattttcagtttaaacagtgaattatccgggtagaagtcggtagagccagaaactcacttttgatgttggtgtgcccctagtggcgagctggattctaaatcgtgccctttattccctgcagccctgaagttcagtccatcttgaagatctcccaacctcaggagcctgagcttatgaatgccaacccttctcctccagtaagtttttgtatgtgccgtgcatctgtggagaactgtaagggagtcagttagtattcctacattaatggattaaaatagcatttctagaaattagtatcaaggcaggaatgcttcattatggcataacaagtgatataaatatttaagtattgagtcagagtattattttattt

SEQ ID NO: 438653 - DNA, 426 bp, Homo sapiens
actctacaggatcctggtcatcacacctattaataagaagatactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggatttcgatgaggtcatcgaaaccctcaccagaggaagttgaggaataaaacacgaccgttagatttcgaagtcactgtgtaccttgtggcaagacttggttgaatccaggtggggaagccagtgagcaacaggttgatgaagggtttgatagacgggtttcgatga

SEQ ID NO: 438654 - DNA, 2859 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctggtgagtggcacattgggaaccatggaacactgcctgctccctacaatattgccttcacacagcccatgcttggccatggtgtcttgcccttaccagtacgcttatcaaaagcagctaagaggcatattggttattttatagttcataagaataatcacttacctggttcttttgtgcatttcacattttactagataggaccacattgaacctgtgtggtggtgaaaaactaccacttattaacatctaccccctcaccctccacacacacacacacaaacacacacacgggttgcaaagtagacacttaaatagcaagggaaaagaaagcattgaggtggggagagtttctcaaatcgagcctaatatttattgccgtttatatctttttctctactggtaatgtgtgccatatgaaacttccaattaagtcctaaagtaattttccccttctttcagccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438655 - DNA, 2966 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctggtgagtggcacattgggaaccatggaacactgcctgctccctacaatattgccttcacacagcccatgcttggccatggtgtcttgcccttaccagtacgcttatcaaaagcagctaagaggcatattggttattttatagttcataagaataatcacttacctggttcttttgtgcatttcacattttactagataggaccacattgaacctgtgtggtggtgaaaaactaccacttattaacatctaccccctcaccctccacacacacacacacaaacacacacacgggttgcaaagtagacacttaaatagcaagggaaaagaaagcattgaggtggggagagtttctcaaatcgagcctaatatttattgccgtttatatctttttctctactggtaatgtgtgccatatgaaacttccaattaagtcctaaagtaattttccccttctttcagccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcgtgagtgatgttttcctgtcctcctgggccggccgggacgtgcactagacctccctgcccttattgaatgcacctgtctaaattaatcttgggtttcttatcaacagatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438656 - DNA, 2545 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438657 - DNA, 2328 bp, Homo sapiens
ttaatggggtttattattttccttaactgactaatgtattggggtattttcagtttaaacagtgaattatccgggtagaagtcggtagagccagaaactcacttttgatgttggtgtgcccctagtggcgagctggattctaaatcgtgccctttattccctgcagccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438658 - DNA, 2338 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttataggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438659 - DNA, 2767 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggtatgagatgtgcttgatggggctggcattggcggtagacactccttgaataatcttgattctggaatgttggtgccaagttgaaacatgccactaaatctgaatcgtcattttcctaggagaagcatattatgtcggagcggaatgttctgttgaagaatgtgaagcaccctttcctggtgggccttcacttctctttccagactgctgacaaattgtactttgtcctagactacattaatggtggagaggtgagcaggggggatagaagtcaactcttagtgtctctgcacagcctgctttgttttagtttgagaaaaaagttttcaaagatttttggtggggagaatgttaccagaattagcatttccttcaacctgtcaggtttatagttaatagattacttggggccacttcctgcagttgttcttttgctgtgtatgtcaaaactaattaaattcatttgcaacccagaatgactttgttctgtctcctgcagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438660 - DNA, 2471 bp, Homo sapiens
ccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactggctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttataggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438661 - DNA, 2389 bp, Homo sapiens
caatcatgcacttaactaccaaaaagagtaaactcctctcagagacttcttaatacagttcagtgcaaataaaatacatttgctgtttgatgtagcatgagaaatcccaagtccttctgttcctttactgaaaagtagctgtttgtaagtaagatctgcatcataaaaactttctaaatccctaagtaagagatatcaagtgcccagcagtttcctaaatgtcagtacacataggtagccagtcaccctcaaaaagtccagcagttttatcaggaaggaatctaaagatatctatcttccaagctggctctgggtctctcagctttttcaaactaaatgtgtggtcgtgggattgcttgctttcgcaggttctaaacgctgtttccctggtctgtttttcagtatctcgcacctgaggtgcttcataagcagccttatgacaggactgtggactggtggtgcctgggagctgtcttgtatgagatgctgtatggcctggtgagtggcacattgggaaccatggaacactgcctgctccctacaatattgccttcacacagcccatgcttggccatggtgtcttgcccttaccagtacgcttatcaaaagcagctaagaggcatattggttattttatagttcataagaataatcacttacctggttcttttgtgcatttcacattttactagataggaccacattgaacctgtgtggtggtgaaaaactaccacttattaacatctaccccctcaccctccacacacacacacacaaacacacacacgggttgcaaagtagacacttaaatagcaagggaaaagaaagcattgaggtggggagagtttctcaaatcgagcctaatatttattgccgtttatatctttttctctactggtaatgtgtgccatatgaaacttccaattaagtcctaaagtaattttccccttctttcagccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 438662 - DNA, 944 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcgcgggggaccttggccaacggaatcccttttggggcgccgggtttcccctggggggttctagcggcttttgaaggctgtgctgggtgcggggcgctgtttgctctcgtggcgcccttttgcgacgcgatgtggcc

SEQ ID NO: 438663 - DNA, 779 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcatgaacacaccacggtgcatgaacacaccacggatgcatgaacacaccacgga

SEQ ID NO: 438664 - DNA, 633 bp, Homo sapiens
aggccgagcgcgggcctagcgcgcatacgccgagccggcgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacagtaagtttgaccggatttgaggaaataactagtatagtttgaatttgccagcggtaaacattctcatcacggcgtttatcgggaaggcgaagacttcttctggggtggggatctcatttctccttaaattctaatatatttgacacattttaaacattaaagttaatttgctgatttggcttgaactggagatgtaagataaatggttcgtgttggccgaattcacggcctttctccatgagcaacaatc

SEQ ID NO: 438665 - DNA, 254 bp, Homo sapiens
ttagctttttgacatcttgcctttctccttaaatctgatcccttgtcactctttttttatttttttgttttttcctctcctgactttcatctgaaaccctgaaccctacaggccatgggagatgacctgtttcccagttttggtcactttttgggccatatttataaccaaaactcttatttaaccagttttcagaaaattctcagcttcttcatcaattgatgaagttatctgactgactttttattccagcc

SEQ ID NO: 438666 - DNA, 2189 bp, Homo sapiens
tgatcactgctgtgccttttagtggtttggggggtaagcagtagaaaagaaggtcaaaatagatttggattaagagtaggcaaaataaacttataacatttaaaaactgaagtatttttaggtttataatattgaaaatcacatacccttagctttttacactttatcagacatttttttaaatttcaagggtatagcaaaatgaaattataactttatgaagaaaagcattgatgaaagtggagaacatgcatttagtctaggggatttgaaactctcccaatactgaagacaaaccctgtcaagaaaaagaagaatttaatattatatagtattttcatatgcagttctttaagctttgtttacttctatacaaatacttttaagtaatgcaagataacatttaatagatggaattgttaaggtaattgcctgtagtcacattgctaaattcattgagagttacacaaaatccagaatatattgtctgttcctaaattatatatatttagattctggaattactaggaggaattagaagtcattcagataaaaattcatacttaacaagagtatctaggaaagagattcagcccatcccaatattgagcagctttccttatcagaaagttttattttctgtttcacagattgctcatgacctttaatacatttttctgaatgaaccctggagggaggtgagaagtagcagttttgttcatctcttctttttgtcctttatctctctgccactgttctcacctcatcctaaaacctggtcaggagggtttgaaacctatcagaactaaaggttaatatctcatctccctcaggcttttttcatttaaaaaaaaaatgggtatattagttaaattagaatacttgttgtagaattattgtcaaaggggaagggaaatacatctaggggaaacatcatgtcttttaggccctttatgtcactgaatgacttaaggctcgacaaatgatattcttggaaagtttaatcttgaggttttcaaatctttttttttaatgtctcccatgtttctcatttgctgattgattcattagttgctcttagtaagatttgtcagttggaaataatgaaggctgagactcatttctaaactcttccataaccatcaccagaagagcagccactgtgttgtgtgatgtaggctaatgcctcccagatagaggtaaagtcacaaggactattagaattccagtggattgtggaactggttttggattatccttatattttcattctgattactgaggcagttctgaaaactcctaccattgaaatagtggtgtgtcttttccttgtttaaggattttacatcatttttatgcacttgaattccaaaatcagaatctctcttttacctatcaacctttattggctattggcttttggcaatgacctttctgttcaaatgtagtcctgtctctttgtttccttagggagtagaacctgtcctttttctcatctttcatttttttgacgtgtcctttctaagagaaggctctctgccgcctgttctgggtgataagtgatattttcatctaatcgttatgtggttgggatgatcatggtgaaatactaggaagacatactctgttgatggactttttctctccaaataatcccaaatagattattttctagtgaatggtttatatctttctcgtcacaaaaatgttcctttgatttctagcacaaggtacagcaggatgcaaatgattctcagataaaatgatgttgacagtatttccttaacaatttatgtaaaactatgcataattttcattctaacttttgacatttttctccataaataaaagtaatgcctgatgtttagttaaagtagatccacctttgcttgattttattagtcttgttctatcctatttctttttaatacactgtttagacttgccaacaactcttaactgagaatctcttttccttcctaggctaagtaattgtgagtgggggaggaagaacattaagagaaataatctaaagactttgttcaatattgtcgaagcctaagaatatttgtgtgtccttctgatgtactgaggctttgccggtaccacaccatctttggattaccataaggttatgtagtaggacttaaaagtactagggcaaacatttgatttttgagaaagatcaa

SEQ ID NO: 438667 - DNA, 6148 bp, Homo sapiens
agcggaggcgccgcggtctgcaggcccccgccgcagggatggaccgccgaggcggcggcggggcggcggaggcggaggcggccggccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaactgtgcttagttaattggttatattttgttctgtttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438668 - DNA, 5314 bp, Homo sapiens
agcggaggcgccgcggtctgcaggcccccgccgcagggatggaccgccgaggcggcggcggggcggcggaggcggaggcggccggccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaacttgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438669 - DNA, 4632 bp, Homo sapiens
gattctgtggtctcaagtctagaatcccgaattgctgccccatactgtaaatttattcagaaccaaataaggccgttggacgtggtggctcacacctgtaatcgcagcactttgggaggccaagatgggaggatcacttgaggccaggagttcgagaccagcctgatcaacatagtgagaccccatttctattaaaaaaaaaaagcttgagcacacaattaccacctaatatgttaatcatttttatgtctgtgttcatctcaggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaactgtgcttagttaattggttatattttgttctgtttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438670 - DNA, 1910 bp, Homo sapiens
agcggaggcgccgcggtctgcaggcccccgccgcagggatggaccgccgaggcggcggcggggcggcggaggcggaggcggccggccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccacctccagctctctttaagagtgagccttatcatagaagaacccggaggtagacgcacccgcgaggggtaccgccgcga

SEQ ID NO: 438671 - DNA, 730 bp, Homo sapiens
aaccaaaaaatttgtgtgacttgctttattgaggtatttgctttattgcagtggtctggagccgaaccggcaatatctctgaggtgtgactgttctctcagcttcatcaaatataaagtggaaagagttttgttcatgaagccactgaatgaaccattgcttgccttaaaggaaggtatagaagtagagtgtttagcttttttcttgaggtcttcgtgtattgctaaggcttgctttctttgtaattttgagaaagcttgctcctgatcacttcagacattaaacttgggaaaatcttgtataaactaacattatttctgagttattctgctatcatttccctatttactaatagcatttgaattaattcacattagagaaatatgcattgtagcagaactcatctttagtctctttagaaaagctattttattgagtaccatcttaatcagtgattgtgaaagccaaatatttgatttgaaccttgcctcaagactgaattatattcaggctttgtaaatcaaagacttcagttttacattaagcacttgcctgttcttactctgcaaatccctgactttctggatttcttttattcttgattataaactgatcattattttctgaattcatccttttcatgtaataatttgttaaatataactaacagtgttacaatacaacacacttgtaatagtccattttcccactagagctgctagctcttatg

SEQ ID NO: 438672 - DNA, 5996 bp, Homo sapiens
gcggggagccggcggttatctgggcggcggagcgctcacaatgtggcaggagacagaaaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaactgtgcttagttaattggttatattttgttctgtttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438673 - DNA, 5608 bp, Homo sapiens
agcggaggcgccgcggtctgcaggcccccgccgcagggatggaccgccgaggcggcggcggggcggcggaggcggaggcggccggccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaactgtgcttagttaattggttatattttgttctgtttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438674 - DNA, 4874 bp, Homo sapiens
gataggggtctgtagaggagggagagatgtggcaggaggttggtcgtggaaggtgagggtcgtacacgaaggaagagagtgtgaaaaaaaagtacagtgtgtttcctgtaacaaatcgttcaagaaactctggtcccttcatgaacatatcaagatcgtccatggatatgcagaaaagaaattttcctgtgaaatttgtgagaagaaattctataccatggctcatgtgcggaaacacatggttgcacacacaaaagacatgccatttacatgcgaaacctgtggaaaatcattcaaacgcagtatgtcactcaaggtgcactccttgcagcattctggagagaagccctttagatgcgagaactgtgacgaaaggtttcagtacaagtaccagctacgctcccacatgagcattcatattgggcacaaacagttcatgtgccagtggtgtggcaaggatttcaacatgaagcagtacttcgacgaacacatgaaaacacacactggagagaaaccctttatctgtgaaatctgtggcaaaagcttcaccagccgccccaacatgaagagacaccgcagaactcacacaggcgagaagccctatccatgtgatgtgtgtggccagcggttccgcttctcgaacatgcttaaggcccacaaggagaagtgctttcgggtgaccagccccgtgaatgtgccacctgctgtccagatcccacttacaacttccccagccaccccagttccttctgtggtgaacacagccacaaccccaacccctccaatcaatatgaatcctgtaagcactcttccccctcggcccatcccccaccccttctcacacctgcacatccacccacaccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatacttggtagttttgacatctctgcttaacactcaagagaggctccctaatgtgctcctgtcctccatgttctgcttggcttcgttagtgcattacatgaaatgatttgcaggggatggggccttttccagggaagtcacctaaagcttgcatgttttgaaaatttgaataaggctgtttgctgacaggaggaggaagtagtggagatcatttcatctcagtcacgtctgtttctcacttcccttaggaattgtgttgatgtttaacttttatgggatgacaaattgaaatcgctcattttgaggttgctttatttttctagaattgttataagaagctaaaatagtaaacttaaaatcacaaacatgacattgctgatagtggctgagaaattcagatgagaagacaaattggttatgaattttgaaatatctattatatgtaaaatgtggatatgttcacaaccttgagctattttaacacagtttaaatatagtgagggaaaactcctaagttttactgccctgtcctctgcaaattatgtaataccagcattcttaggcgataaagagagcagcacctctagtacctttaggcagattactttttcaagtttggggaacttcaaaagaccataatcaaccaggagcttattataggaaaggctgaacagaagggctagtgtattgattacacttaacagatcatatttatccagactcagtatagcttaaaattttgtatttctttatctgagagaactgagttcccaggctaaatcacttacctcccaccccctctccaattttttttttaagagacaaggtcttgctatgttgcccaggctagagtgcagtggctattcacaggtgcagttatagcacactacagcctccaactcttgggttcaagcaaccctgcctcagctaaccaagtagctgggactacaggtgcatgctaccatgcccagtccattttttaatcttgaaatttcttcatttttctttcttcggtttcttaaaatctttgcctgaatcagaacgctggcttttatttatttttttatttttaatattaaatgtgcagatatgcttcgagcacttttctaactaatgagctctgtggtaagaaaaaatgaactctttcaattgagattaagtccatatttttcaaacatcacgttctctattggctttttggtttagtgtttctaaattttctccttctgattttgcctgtcttatataatgagcataggaaaattttggaatgaggcagaaaagtatatcaagacatacttcctggttttggatgtaagttttaaagaatggtatttttaatatttgtacacattctttgagcacccaggtacccaagccaataaggaaagttaattccttgcatatgactgttatatctttagtggttgtctccctctccctccacagtctccttggcattccatgacaagtttgtcaacctacacttttatatagacatgtcattatttcatggtcaagcctgtagtattaaaatgatttttttaaaagatgtaaactgtgcttagttaattggttatattttgttctgtttttttttttttttttttttttttttgaggcagagtcttgttctgttgcctgggctggagtgcagtggcgtgatcttggctcactgcaacccccgccccccgggttcaagtgattctcctgcctcagcctcccgagtagctggaattacaggcatgcgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggctgtctctcgttacttagttttactgtcttcaaaggcttgtatcattgctagggttaagacttatttgaggatgagttggcattgtattttttgtgtgtgtgggttggtttgtatttgtttcgtttttatttttctattttctctcatagatttatcagtaaaatataaactcttccttagccttaataaaggctgctgctttctcaaattgagtca

SEQ ID NO: 438675 - DNA, 2537 bp, Homo sapiens
agcggaggcgccgcggtctgcaggcccccgccgcagggatggaccgccgaggcggcggcggggcggcggaggcggaggcggccggccggtggtctggagccgaaccggcaatatctctgaggtgtgactgttctctcagcttcatcaaatataaagtggaaagagttttgttcatgaagccactgaatgaaccattgcttgccttaaaggaagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagcccaaagcaccagtccagaaagctaagtgtgaagagaaagagactctgacctgtgagaagtgccccagggtatttaacactcgctggtacctggagaagcacatgaacgttactcataggcgcatgcagatttgtgataaatgtggcaagaagtttgtcctggaaagtgagctgtcccttcaccagcaaacagactgtgaaaaaaacattcaggtaggtttcatcaccgagagggaaaacttttcaggatagaacctggctgttcagattcatctggtatccgcccaagagaataaatgcaatagaggctgaagggacagttttcaccaatttatcatttgaaaagctcctgctttggtcttttctaaaccaaggcttttatttcaaaagcattaaatttgacgctggactagtgggaacccaggcacactggaagggggatctgttatagttgattgaccaggaggttaaaatcaacaccaactttgcactgagattcactgttgtaggacgtgtaatagaattcattctggcatcttctctgtggaggtaggagttactgattaaaggttaggagtagagaaaggtccctttctgggtttacaaggatgccagattctagtacagctgatggggacaaaaaccataatgactcagaccggtggaaatggaagatcttcagcagtgagtttgcttttaccattggagagatgacaacactaaatttgccaagaggctgagcccatgggaatatgcaaactttaagcagaggctgagctggtcgaaaatgttgcccacctggcagtagggttacataatgccactgtacagtattgttaaggtaacaaaataacggtattcaaaccaggctgttgtcgtgaaaggactatattgtgataggttaaagaggtatgctaattatattatgtcaagtggattgcagttatattggtttgcacgtgtgaatgcatattaatgaatattcgtaagaggtaagtctattcatgtctccataagatatgtaacagaaatattttgtaccatatttaagctaaacttataaaggataaattgtgttggtttggtttgttttttggtgtgcttctaatattggtagtcactttttaagtttcacttttcttctgttgcttttaatcaacatctgagatcattgctctactttaaagagttttaaaaaatggaaattgcatttgctaaaaattcaccgcttttgattcaccaattgtgacttgatctccaacacgctgggtaaataaaagaagactgagtcatggagcccatatcctccggtaactgccagtgccctggcttgggtatgaattgtttgcagcacttcaggccaaagggagtgtggtgca

SEQ ID NO: 438676 - DNA, 1832 bp, Homo sapiens
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacat

SEQ ID NO: 438677 - DNA, 1921 bp, Homo sapiens
gccttggacctgtggcctttgggcttgggtgtctcctgtccgctctgccagtgagtcctcagctctccgtacgtggcccgtcgcccgcggcaagacggagggaaggcgctagttcagtttagctagcaatgcccttcttgcgcgaggactgctggctggtggcgaggcccaggagcctgtttgggtgttaacagttaaaacagtaaagtttgcgcgggcttctgtggttttcagtcttttccccacttcacgtgatctcatttcattgaacaacattaaccaccatttaagatacgtgaaacctgcgaagtggaaaggtgcacgcaaagttaatttacaccccccgcgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacat

SEQ ID NO: 438678 - DNA, 904 bp, Homo sapiens
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccacctgaaggacttattcattaatgattcggctgctttccagtattttaattaatggaaaaaaaattgataaccccaccaggcgcggtggctcacgcctgtaatcccagcactttgggaggctgaggcgggcagatcacctgaggtcggcagtctgagaccagcctgaccaacatggagaaaccccgtctgtactaaaaatacaaaattagctgcgcgtggcggcgcatgcctgtgatctcagctgctcgggaggctgaggcaggtgaatcgcttgaacctgggaggtggaggttgagatttcctctacatgacaaagaaagactggaaaagtggttaaagaatatgaagcgagattcatgggttcccagtaaataccagtttctatgtagtgaccattttactcctgactctcttgacatcagatggggtattcgatatttaaaacaaactgcagttccaacaatattttctttgcctgaagacaatcagggaaagagaacctttctaacgcatacacaatccccaggaagcaaaacacttgggaaacatgcagcaacagaagtattgccacacaagcccaagctcagaagcaatcctctggtcttcacctgcagacaacggacaacaacttttacgtctccc

SEQ ID NO: 438679 - DNA, 581 bp, Homo sapiens
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatacagctaaaacgtaaaaggaaggtgttgagaagggggacatacaccagaaacagactacagtagtgaagaataaggaagttaggtatgaaaataaagaggaaaagatgatttctctgagtcacaaatgaaaaagtgacagtacacttcagagaaatagactagatggatggatggatgatgcaggtaaatgaggctacttgaagatctatatataatatagcactgaaattgcttaccatagtcatttctttcctctctggatactagtaatgtaaaaaacttaacatattaaagtgttattaatttccatgatattt

SEQ ID NO: 438680 - DNA, 1526 bp, Homo sapiens
  misc_feature (1363)..(1363): n is a, c, g, or t
ttttttgagatggagtctcactctgtaacccaggctggagtgcagtggcctgatcttggctcactgcagcctctgcctcccgggttcaagtgattcttctgcctcagcttcccgagtagctgggattataggcacacaccaccacatccagcttatttttgtatttttagtagaaacggggtttcaccatgttggccgggctggcctcgaactcctgaccccaggtgatccacctaccttggcctcccaaagtgctgggattacaggcgtgagccaccgcgcctggccaagatagaacttttataattttattccagttgaactaaactaaggaaccacccattagcccagttcttaggagaggtacttcaaacttgaaagaatatgtatttcggtaacttatatgtggctaaccatcaaatacatagtcatctaagctaaactttctgtatttatacagttaaacttataaaccaaaaattttaatgaggttaattttaaatatattttagaaattacagttgtatctgtttcttagtaggtgtggcctttaaaatatgtgcttattcattgttaaattccagaataatagagtaatacttaatactgtacattcccacttacgtatattttattaaaatttataagcaagaaattatacataagtggtcatgatcttagggagacaaagaatttctcttagaaaagagaagtaatggtaatgtaaataaaaatactgtttatattcacatgattttaagaaaaactgtaaaagcaaagattttgtagtaatgacacaaatgtaacaaatagatgttttcttaaaattggcagtcagtataattatgtttctgcctatgatgttgaggaagttgtatcagtctgattcttagttttttcatctgttaagtagaacgtactattacttaccttaaagagtggctttgagaattttgtaaggaacaaacatgtttttggttctggaatataggaggtgctcaataaaagttgactctgactggcaaataatattgttttgtaaatgcatgatgattatttttgaccatatttgacttagtttcattaggctaatgttaattggtactatatgaaagtgagtcaactaattataaaagattagaaatgtcttaggtgacgatgggggaaaaacttaaaatttttgcataaattatggggagatgatagagttattacagtgttattaagtattcctatgttgcattttgcaaatacttaatttaatacagatgaaaataatcttgagtcacaataaagtaatgatatgttaagtttcaacagtgtacattgtagtaattttctgaaagttacaggttcctcaganaaaaatttaaactagctttatttctttaataaattatacagtaaaagttgactatctgaaaatcccaaccaataaaacaacaaaacacacacaaacaacactttttttccccccactgccctctcaaaactctcttcaaaacccactcacttggaccgcggcc

SEQ ID NO: 438681 - DNA, 1393 bp, Homo sapiens
  misc_feature (1230)..(1230): n is a, c, g, or t
aaacaattcatttagatctaacctggttcagattttcagcagttgttttgtgctcattttactttagacctgaaggacttattcattaatgattcggctgctttccagtattttaattaatggaaaaaaaattgataaccccaccgcgcctggccaagatagaacttttataattttattccagttgaactaaactaaggaaccacccattagcccagttcttaggagaggtacttcaaacttgaaagaatatgtatttcggtaacttatatgtggctaaccatcaaatacatagtcatctaagctaaactttctgtatttatacagttaaacttataaaccaaaaattttaatgaggttaattttaaatatattttagaaattacagttgtatctgtttcttagtaggtgtggcctttaaaatatgtgcttattcattgttaaattccagaataatagagtaatacttaatactgtacattcccacttacgtatattttattaaaatttataagcaagaaattatacataagtggtcatgatcttagggagacaaagaatttctcttagaaaagagaagtaatggtaatgtaaataaaaatactgtttatattcacatgattttaagaaaaactgtaaaagcaaagattttgtagtaatgacacaaatgtaacaaatagatgttttcttaaaattggcagtcagtataattatgtttctgcctatgatgttgaggaagttgtatcagtctgattcttagttttttcatctgttaagtagaacgtactattacttaccttaaagagtggctttgagaattttgtaaggaacaaacatgtttttggttctggaatataggaggtgctcaataaaagttgactctgactggcaaataatattgttttgtaaatgcatgatgattatttttgaccatatttgacttagtttcattaggctaatgttaattggtactatatgaaagtgagtcaactaattataaaagattagaaatgtcttaggtgacgatgggggaaaaacttaaaatttttgcataaattatggggagatgatagagttattacagtgttattaagtattcctatgttgcattttgcaaatacttaatttaatacagatgaaaataatcttgagtcacaataaagtaatgatatgttaagtttcaacagtgtacattgtagtaattttctgaaagttacaggttcctcaganaaaaatttaaactagctttatttctttaataaattatacagtaaaagttgactatctgaaaatcccaaccaataaaacaacaaaacacacacaaacaacactttttttccccccactgccctctcaaaactctcttcaaaacccactcacttggaccgcggcc

SEQ ID NO: 438682 - DNA, 617 bp, Homo sapiens
gaatgatctgaaatgtttctgccgtatattgaatgggattaatgctttttagaaaatactttaaggtatatatactctgagcttttttttaactaaataaatttgcttggccagtgtactactcaatattataattaaatagcactagcataataagccaataaaagtcatctttttcagaacatgaaaatattattttctagggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactacc

SEQ ID NO: 438683 - DNA, 1639 bp, Homo sapiens
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacat

SEQ ID NO: 438684 - DNA, 1710 bp, Homo sapiens
cgaaaaggcggtgcttaaaccggaggaggcggaagtgagtcgacagacgaggcggctttcccggcagaatgctagcgcaggcgcaggggctcgagaggcctggacctgtggcgcatcctcagtgaggagggccgccctgcatccgtcgccggccccggtctccaggggcctcacccgagtcatgccccgctattgcgcagcgatttgttgtaagaaccgccggggacgaaacaataaagaccggaagctgagtttttatccatttcctctacatgacaaagaaagactggaaaagtggttaaagaatatgaagcgagattcatgggttcccaggaaaagacccttctaaaaaaaaatcccagaagaaaaacttggaagatgagaaagaagtatgcccaaaagccaagtcagaagaatcatttgtattaaatgagacaaagaaaaatatagttaacacagatgtgccccatcaacatccagaattacttcattcatcttccttggtaaagccaccagctcccaaaacaggaagtatacaaaataacatgttaactcttaatctagttaaacaacatactgggaaaccagaatctaccttggaaacatcagttaaccaagatacaggtagaggtggttttcacacatgttttgagaatctaaattctacaactattactttgacaacttcaaattcagaaagtattcatcaatctttggaaactcaagaagttcttgaagtaactaccagtcatcttgctaatccaaactttacaagtaattccatggaaataaagtcagcacaggaaaatccattcttattcagcacaattaatcaaacagttgaagaattaaacacaaataaagaatctgttattgccatttttgtacctgctgaaaattctaaaccctcagttaattcttttatatctgcacaaaaagaaaccacggaaatggaagacacagacattgaagactccttgtataaggatgtagactatgggacagaagttttacaaatcgaacattcttactgcagacaagatataaataaggaacatctttggcagaaagtctctaagctacattcaaagataactcttctagagttaaaagagcaacaaactctaggtagattgaagtctttggaagctcttataaggcagctaaagcaggaaaactggctatctgaagaaaacgtcaagattatagaaaaccattttacaacatatgaagtcactatgatatagaataactaggttttaaaactatggctgttaaataagctttttccagccaaaccaaactacatgtaaagtgaactgtttcctgtataaagttctcatcttaatgaacctatgagagtgttgtaaagttatgaactgtatcctattcttgtaatacttatttaagaaaaaccagagagttgggctggagagaaaagcagttttattacttgataattttccaaattaaaatttagcacatagaaggattcagttataacatgagaaaacaaagaagtgttcaaagagcacagactagaagtcaggttcaggaatcagtcctggttctaccactggcatatgacttgggcaagttacttatgattgtgcctcagtccctaatttgtaaaataagcacttactggatttgtaattggttatttatagtcccttccctttttattaagataattctattagaacacat

SEQ ID NO: 438685 - DNA, 870 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtgagtatccaaggactgcaatgtcctccctgctgttggggct

SEQ ID NO: 438686 - DNA, 1120 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctggcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagcctgaacttggggcaatggttccaattcctgaacgtgctggaggacatgggtgaagggacatgctggggccaggacgaggagccgacggattcgtcagaaatcatgaactcccaagagtggccctaaggggagaccaggagacagaaccccgtgcctggacttagcggacggagaaaggcctgacagctggtaccatggccagggggaccccctccaaagtccagaggctaaacggaagtgggcacacgcaatcgaagggcccctgtttgtgggcacatcacgctagcagggcaccgcagattgcgagcgaagatggaccacaccgcgccaggaagtgcaagtccca

SEQ ID NO: 438687 - DNA, 233 bp, Homo sapiens
gctatggccttaggaagagtgaatcccctataaggcatggggctgccagggttcggccctctctccctgactcccagctttgatcctcagaggagcaggtagcccaggacacagaggaggttttccgcagctacgttttttaccgccatcacagggatttatccccaccctcatagacaactctgccgccaagaagttggcccgaacacagtcacttaggtgctttcagatta

SEQ ID NO: 438688 - DNA, 2560 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcacccaaaaaaaaaaaaaaaaaaaaaaaaaaaaaaaaaaaaaaaaaaagggggggggggctataaattttccccgggggggccccatttatggcttccccttttttttggttccaaggggggcccttaaagggaggcgatggttaataatagagggaagcggcagggggggcgggggtttaacaaagctgtggggcggtggggaacaagtggttgtgtggaaactctggggaaggagacccctatctttcgtggggggcggactatttggggccactacccaagagaaatttaggcctaggggacatacaacgttcggtgtttcgtggttaccaacgggaatagtctgggttaaaaattgtcgggtgtttagaatttag

SEQ ID NO: 438689 - DNA, 2125 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctggcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccc

SEQ ID NO: 438690 - DNA, 526 bp, Homo sapiens
agctacgttttttaccgccatcagcaggaacaggaggctgaaggggtggctgcccctgccgacccagagatggtcaccttacctctgcaacctagcaggtgagctacaaccgctgggcccacaaggacatcttcagggaggcagtagctcgcatgggtctctgtgcaggtcctgggagctggggaggcctcgggggtcttgcccttctctcatggttgctcctcttttatgttgggctcccacccccatccaggaccttgtatcctttttagcccatgcctgccccttctcctggagcccagcactcatgtcttagaacactgtcagggacctccaagaagggatgcacagggccatggacagctcaggcagaacccctctgccatgagccagggcctggtcccgactgcctggttactggctcacctgcatgcctcctgctcctacagcaccatggggcaggtgggacggcagctcgccatcatcggggacgacatcaaccgacgctatgactcagagttccaga

SEQ ID NO: 438691 - DNA, 2186 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcaccc

SEQ ID NO: 438692 - DNA, 2579 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctgaggagcaggtagcccaggacacagaggaggttttccgcagctacgttttttaccgccatcagcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccagcctgtttgagagtggcatcaattggggccgtgtggtggctcttctgggcttcggctaccgtctggccctacacgtctaccagcatggcctgactggcttcctaggccaggtgacccgcttcgtggtcgacttcatgctgcatcactgcattgcccggtggattgcacagaggggtggctgggtggcagccctgaacttgggcaatggtcccatcctgaacgtgctggtggttctgggtgtggttctgttgggccagtttgtggtacgaagattcttcaaatcatgactcccaagggtgccctttggggtcccggttcagacccctgcctggacttaagcgaagtctttgccttctctgctcccttgcaggggtcccccctcaagagtacagaagctttagcaagtgtgcactccagcttcggagggcccctgcgtgggggccagtcaggctgcagaggcacctcaacattgcatggtgctagtgggccctctctctgggcccaggggctgtggccgtctcctccctcagctctctgggacctccttagccctgtctgctaggcgctggggagactgataacttggggaggcaagagactgggagccacttctccccagaaagtgtttaacggttttagctttttataatacccttgtgagagcccattcccaccattctacctgaggccaggacgtctggggtgtggggattggtgggtctatgttccccaggattcagctattctggaagatcagcaccctaagagatgggactaggacctgagcctggtcctggccgtccctaagcatgtgtcccaggagcaggacctactaggagaggggggccaaggtcctgctcaactctacccctgctcccattcctccctccggccatactgcctttgcagttggactctcagggattctgggcttggggtgtggggtggggtggagtcgcagaccagagctgtctgaactcacgtgtcagaagcctccaagcctgcctcccaaggtcctctcagttctctcccttcctctctccttatagacacttgctcccaacccattcactacaggtgaaggctctcacccccatccctgggggccttgggtgagtggcctgctaaggctcctccttgcccagactacagggcttaggacttggtttgttatttcagggaaaaggagtagggagttcatctggagggttctaagtgggagaaggactatcaacaccactaggaatcccagaggtgggatcctccctcatggctctggcacagtgtaatccaggggtgtagatgggggaactgtgaatacttgaactctgttcccccaccctccatgctcctcacctgtctaggtctcctcagggtggggggtgacagtgccttctctattgggcacagcctagggtcttgggggtcaggggggagaagttcttgattcagccaaatgcagggaggggaggcagatggagcccataggccaccccctatcctctgagtgtttggaaataaactgtgcaatcccctcacccaaaaaaaaaaaaaaaaaaaaaaaaaaaaaaaaaaaaaaaaaaaaaaaaaaaaaaaaaaaaaaaaaacaagaagaacaaaaaagaggagggggggggcggcgcagaagaatagacccccgcgggggcggcgcagccacggttcggcgggcagcgacggcggagtagtagagacgcaaggagagggcgcccccccatcataggggcacgactgatcaatacgaaggagcacagacagagacgagagcagacagaagaaaataccaacagagcgccggcgaaggggcgcagacgcacagtgggactgcagaagggacaacgtgctagacgggcgacacccaactacacgcggggggaggagagaaaaaaatgacgtggaaccgacagagcaacggg

SEQ ID NO: 438693 - DNA, 867 bp, Homo sapiens
catccgggtggccacagagcaacttcctctagagggagctgattggagccgggtgccgctggcacctctatgatcactggagtctcgcgggtccctcgggctgcacagggacaagtaaaggctacatccagatgccgggaatgcactgacgcccattcctggaaactgggctcccactcagcccctgggagcagcagccgccagcccctcgggacctccatctccaccctgctgagccacccgggttgggccaggatcccggcaggctgatcccgtcctccactgagacctgaaaaatggcttcggggcaaggcccaggtcctcccaggcaggagtgcggagagcctgccctgccctctgcttctggcaggaacaggaggctgaaggggtggctgcccctgccgacccagagatggtcaccttacctctgcaacctagcagcaccatggggcaggtgggacggcagctcgccatcatcggggacgacatcaaccgacgctatgactcagagttccagaccatgttgcagcacctgcagcccacggcagagaatgcctatgagtacttcaccaagattgccaccaggtaccccagccacctccctgccagctccagtcactcctctgtcatgtcacaaccataccataccctgcctgcatgatgctctcctggcatggggagaagccttctgtcagtgtccaatgtctgctgtgaactcacatgtggtctcggccccctatttttctctttcggggtcccagacttgtattttgggcattagctcacagctcttttgagctctgactccaaggtcttgactggttagatcaggactctagagggggcctgaggtggggacgtccccca

SEQ ID NO: 438694 - DNA, 6291 bp, Homo sapiens
gagacggagtcttgctctgtggccccggatggaatgcagtggcgtgatctcggctcactgcaagcaccgcctcccaggttcacgccattctcccacctcaacctctcaagtagctgggactacaggtgcctgccaccacgcccagctaattttttgtttttgtatttttagtagagacggggtttcaccatgttagccaggatggtctcaatctcctgacctcgtgatccacccgcctcggcctcccaaagtgctgggattacaggcgtgaccactgcgcccggcccagatttcaacttttattttatttcctttcatttattaaataatataaataatgacagatttattttaggtgttagcctatttttgcatgagagatttacagaggtggaaattctcatgcttaacttatgcaatgagacaatttctcaggaagcaagtttgacatgctttagtctctctcttcttttttttcctcccaaatatttgagttagcttaaattcttttttatggactgcccaaccagtgaattgatgcacttagacaacaagtaatctgcagcagaatattgcatccaatttgagacttgattccatattattgccttaaaggctattaaattgggtgacttttagtatccagctgttaaaaagaggaaagactgtttaatatcattccaaaatttttgtgaaatgtggcccaagatctaaagtttttaagggaattatttttaataaatatgatctgtccctttttgaaaaggatccatcccttttcataataaaaataattccctcctaccacccagttgcacatacttgcatctgttatgtattgaaggataatcccccccaaaaaaactatccaagagcagagatgtttatattttgaaacccatttgagtgttacagtattatatgactaaagctgaatcagtctgtggcctggtatttgttatcataaaggaagatgtacacctaaggtatcaagtggttaaaacagcaaagtacaagatgcatttttgtatttattctaacttttgaacattagtgtctttcagtataaataaatgtgaacaaatatacctcagtagtaatacaggagaactaaatatcctgctataacttaatacagatacatatttcaatatgacttaacaaacacacaattttgaaaaaaaaaaaaaaaaaagtgcagcaacttaaacacatttttctccccagaactaagattacacttaatttaatttaatgtgtttctgcgttatactagagttttgcaggaatttttctgaatagtacattcacatgatagatacggataaataccttatttactaaaatgttttgaaacatattttatagtccctcatttgatttgaaaaaatttgacaagatcttcacattgaaagtaaggacgagaatatttgcagatttccttcgttccaaaattattttattccaaagaaaaattgagttgccactatcaggaaaaaaaaaatgtatcacttctgttagaaggctatgaagtatatataaattatatgacaatttttatcatatagatttgatatcttctatgtattcgtatttttgcatcttgggtattaagcaaaataccatatgtataaatatgaaaccaggaatgtgcatattttagaaactaattgtgtatcttaagtgaatgttttgagtagttctgtcaccccattctaaatattttacctacaacatttaaattattctgatatcaatcagataaataatccgagtgtatttcatctttctacattgtctttgtggtttttgtttgtttgtttttgagacggtctcacactgtcacccaggctggagtgcagtggtgcaatctcagctcactgcaacctccacctcccaggttccagctatcctcccacctcagcctcccaagtagctaggactacaggtgtgcaccaccatgcccagctaattttttgtctttttgatgtagatggggttaccccatgttgcccaggctggttgtgaactcctgagctcaagggatccccccgcctcttgcctcccaaagtgcttggattacaggtgtgagccaccataccacctgtctttgaattttttaacgaggggaaagaaaactgcaattcctgcctccccatttatttaaacataacacctaggattttatttttggtaactacttagaataatatagtaggttacttatcttcggttagaaagaactatggaaaataggaaccaataatttggaagtattatttccttatttcatatatagaaataattatcttatttccttatttcatatatagaatattctagatacttggatggctggggttgatgttcttagtatttatcatagtttagcattggttgttatttttaagcatcagaatttgaaagccaatgataatacctgattaggactgaaaatagaattatcttagtagtttagcactttttataatggagttggagcactgaatttattttcaaattacctagaattctgcattgctcaaacattattcaattgattgcaaaatataccttggaaaccctttggatagaacagttcagagggttaccactagtacttagagcctaaagtcactcagtaggaggttctcaaaggtctatttgaaggcaatccaatttctttaaaataaaatattttttgccttttaaaacagatgggtgaagaaagggacgtataaattctgggaaacctcttatgttttcctcccatttccttctatgtctccattaatgtgctaacttgaaggaatttaacttcaaggaaagttgactgatgaagtttatgtagagctgtgaatattataatttgtcaatactttattgataatgttaactttgtttttatttggaaacattttttccagttgaccaaagcagaattcattctgttcttccctcaaattcatctattaggatcaatgtgattgacatttatctccactctgcatgtcactgatatggtatagacgctataagccctgtagatattatgggtatgaagactatttgaggtgaattggcagtgagagcaaattttggaaacaggagagagaactacttcgtgcctataaaaagctctctcactccttccccaagaaaacaggagtctgaattttggccagctgggtatttgaatcttactgactgttgcagcactggtagtcctggtaaattttttcagtgggcgagcttttctgaaatttgattaaacatattagtcaagggaatctgtgaatagatttagaagtagaatgtttgaggtggttgacaagacatttagaattgtgattaatgttttaataaaatgctaagttagaatgaataatcataattatatagatggaagatatattctaacagttcttaaataattttagattctctaaatttagagtgttttctagcttagagagcaatattaatattttttacctagtctactgaacataatttcagggagttagtatttaggactttttacctagagatgcggtaaaccttttaaatttaaatttgctttcttaaaatacctgttccaacattgctcacctttcttctccctcctttttgccctctccttcagtgggaggagcacatattcagctttctgttaaacactctttggttttcaactgagtaaggcaagcaaggatatatgttagaagagtgggcataatactttatattaaaattatagggactaaaagtctaaatcattgctgtcaataggactttttttgatgatggaaataatttatgtctgtgctgttcaatatggtagccactcgcagaggtgactactgagcatttcacgtgtggcttgtgatacagaggaactaaatttttaattttacttaattactttaaattttaaaagttacacgtggctagtgggtctatcccaactatgaagagaataaagctacagagcatctatctagtctaatgaaacaacagtgaatttgggaattgtaaatctgtcttaagctttttccataaacttttattgatataatttaggcatatacaaatactggtgaaattttattgattgaattattgttgacttttttttcagtatttatatttttaaaaagatatgtttctttataattaacttgtattgtagggtaaccattgtccttaaatgttaagccacttagttaataacaaatagcatttggttttttagcattatttatcatctgaggctttcagaattaatgcaccaaaccttaaatatttttgttgttctctaaaagaatgggtttatgatgcaccaaaaggacattttgagaactgccggagcaacagataccaccatgtaaggagtgaattcccatgtttttcacttatatctagaggcctacttatttaggaggtttcctaagtaagtgtatttagttgtaggaccttagagttgcctaggtccattctattctagcatatactcaacatactgccagagcaaatgtaggttgcagattcaggcaaaacacacacacacacacacacaaaaccctgaagagcacaatgagcattattagcacagccaatttaaaatgatgaggtgttaaccacatttgtataaataatagtttctctaaccctgaatcattatcctgcatttttaatgcaatcggttcataaacatcaaagtgaaaacaccaaatttgtaagaggtcaggaccaactggggctctaaatggagagacagctgagagctgtgtccctatgcgtgggtggccttgcagctgttgattcaccctcaggctaccagacagttgcctctttgcatttgcagaaccagacttcaatcttaggtaaaaatgtatccctcccatggacaggacataaacaatagattgacatcagctctgaaaacagtgcagcagccagactcagcagttgccctgaaatactgagaagtaccaagcataacatcaagactgtttctacacaataatatttgtctttgtacagcaacactgggttctcttaagtatattataaatataaaagctcaaagtccaaaaggttcaatgtgatgatatccttctctacaaatgccaggaacaccagggtagattgcatgagacatgactgccgtatcttggtccttactaggattcccaaatatactccttaataaccagtaaagttatatttacactggacattttaagaaataccagtgttcgttgttagatgagagacagcataattttggaatcacaactgagttcagagttcagttttgagtcctactagttttgtttccttgtgtaagtttcttaacctttgtaaggctagcatgtaaatcagatacaataatatatagttcagggtgtaaagattggattaatgtatgcagtgtctatctagcacagtgcctgttatgtagtagcgtgtcaagagatgttctctcttatgcatttggaggattaggtgctgcacctataggtttccattcatttctcatctatgtaattctgagtcttccttttctagatagaattccccccaacaaaaatttaaagtctaacaggtggtaggtgcttattgaggcccagcaattctacttctggaaaccttcctcaggaaaagattctgatgacagaaaatgctgtgtgaacagtattatatagaattgtttttaatagcaagaaattttttaaaacttacaagttcagtgatatgaggacatttacataaactatcgaaccaccagtcttctgtcaattccttttaaaatgatggttgtgaagactgatgaaaacacagtgtcaatgatatgttaactgaaaaagtaagattaaaaacattatggatagtataagtttcttaaatgccaacaatgcatgaggtgaatagaataagacttttttttaaagaatgtaatttttgacagtctgaaaagacaggccttatatttatattgagaaaaatgatcctgacatttaatgagacactaaaacagtttttattttttgcttacttattctgttctagaatccaaactctacatactgtttaatagagcattattgatattagctgtattagatgactgtatgaagagtcctgtttgctagaatcctactttatcttttaagttttgctaattaccctgcaatgaatgttgaacataaaaaatttgactccctttccatgtgtccactgtttccttgtgccttttgattaataaaactttatttttaagtgaga

SEQ ID NO: 438695 - DNA, 863 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaagaaggaaagaaggagaaaaaggaagaaaaacaggaagaagaaagtagaaacgcggcaacgacaagaaacaagacacgctatacgcaaggacagaagcaagcaaagaacggacacgaggacagaccaacgcaacgcagcgcacgacgacacggaacgaaaggaccgaaaagaaacaacggagcaagaaaagaagaactaagaaggagaagacggacctcaga

SEQ ID NO: 438696 - DNA, 2065 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438697 - DNA, 2206 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagataacagtgctgtgccaaaaacctgtggattttctctacaaaaattatcatgactgttatctttttgatggaaaagatgaagttcagcgaagaacaaatctacaacttggccagaagactgtagactttgccttcaaagagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438698 - DNA, 2005 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaagcgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438699 - DNA, 1969 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagataacagtgctgtgccaaaaacctgtggattttctctacaaaaattatgaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438700 - DNA, 762 bp, Homo sapiens
gctgcatgtccagactattttaacgacaggaaagagctatagtatgattacgagatcatgggctgatagtatagaatgtgcgcaaagagttgttatccatcacttgatgttctagatcaatttgtaaatatttctacatgcaacctatatttagaagctttaatagcaaacagaatgaaaaacacccactcaaaataccaccatccagtcatcttacatagctgatagtgccttaagttttcacctgactcagttgtaccagtttaaaaatgcctaccctgacagacttgctttccagccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438701 - DNA, 376 bp, Homo sapiens
ttttttaatagagttttgtgtgtcttattcttaaatttaaaaaagcatcttcagaaggtgcgatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438702 - DNA, 748 bp, Homo sapiens
aatcaatgcataaagtcattaggtaattaacagaatagatgtcaattggacatggaattgaagatacactgatttttaaaattacaatatcctcttaaggctccaattgactaactcacaaaacatcctatgaacattttcctccattaaacatgatatcaaagtcagccttccttttacaagcaccctcacacccctacaggactactgcaatcacctagtcaaccctcctactccttcatagatgaaataattaaagtcagaatagatttagtgccttgccaagtccctcagcttgtcagaaattaaaattcacaagagtgttgtaaggagaagaatgattatacaaaattccttacatgcctcaaacccggtgcattggatgggattatgtttggcatatgttgaactaggaaaagatagaagagcaattacccaaaccaaatgttctttattatgtctttatctgcacatgggaagttttgcataacttaatcagatctagcggccataataatagttaattcaaaaaggcaaattgtaagtaaacaaaaaagttagatgggcctattgaataaattacacattctttaaggataaaagctccaaacggattaaggaatgactaaagctgtcacctaattacttcttgaaaggaatttagaggttcctatagatggaagcagtgtgtctgggcacatgcccagagccagaagcgagcatgagcacagcaattcctggcctcaaa

SEQ ID NO: 438703 - DNA, 450 bp, Homo sapiens
taagtataaagtgattctgacacaggtggttgaccccactttagggaacattgtcctaggactgtttaaatatcattgaaaatcactgagtccacatattgtgtccttaaggacactttttaaaacatatatattaacttttagctttaagcaatatgttaaatgttcgtatttctaaaagaagacaaataagccaaaagggagcaaatgtgaattcctttcatcaagttttctctgcctcttcctccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaa

SEQ ID NO: 438704 - DNA, 2113 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438705 - DNA, 2208 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438706 - DNA, 2089 bp, Homo sapiens
  misc_feature (1)..(1): n is a, c, g, or t
ntttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438707 - DNA, 777 bp, Homo sapiens
gatcactccgaatttacctgagcatgcattctacatattttaggaacaatttgttcactgatgctttagaaaagccatgtagtgaattacttgtatgtcccaggaatgtcatcaaccactgatgttctagatcaatttgtaaatatttctacatgcaacctatatttagaagctttaatagcaaacagaatgaaaaacacccactcaaaataccaccatccagtcatcttacatagctgatagtgccttaagttttcacctgactcagttgtaccagtttaaaaatgcctaccctgacagacttgctttccagccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagta

SEQ ID NO: 438708 - DNA, 422 bp, Homo sapiens
catgcccagctaatttttgtatttttatgagagatgtttcaccatgttgtccaggctggtctgaaaagcctgacctcaggtgatccacccaccttggcctccctaagtgctgggattacaggcgtgagccagcacacctggcccacttctgtcctttttcatatgctatttcatttactgataatacctttctccgtacccccacccaaagcttgagttattgtctgttcatttgtgtgtttagactttattcacccttcattttaggatggttgtttctataatacataaaagatatctacaaatttgacctttaatgtaggaacaatgacaaaccactgaaggctttccaatcaggagagtgatgtgagcagatttatatttaaaagcagtggttcccaagctttatgttgcatcagaat

SEQ ID NO: 438709 - DNA, 2349 bp, Homo sapiens
ctgaacgcgccccatctcttctgatctcggaagctaaccaaggtcagacctggttagtgcttggatgggagatcacctattactttttctgtaggtttttaataaagaatatgggtgctttgatgctagtaatagtgaactttgaaataattattgtgaatcctgaatgagaaacctgtttttttctccaaaatttgaaaaatatcttgaagagagtcttgctttagagacaaattggaaggagatcctgatttgcttttgtggccgtatccaagaggaattgagtgcaggtggggtgcagggaaaacacagtccactccccaccaccactccgctccttccacagcaaatggggactgctcagaaaaccctgtcctttcttttcctctcttcaaaggcaggcatgtgattgaggatgtgatggtgacttctggcctgttttattttgtggtaacttcactttagtcagggaaataattggaatatctttaatctgatgtagtttgacctttagaaattgaaagtgaaacagctattgttgataattcacaaagtattaataaaacttctattacctgtacagattttttacttaatctgcgagaaaactatttagaatattatggaattgtgccatagcttctttatttgttcttaattctatattagatttttttttctctgcttcatgaacaagttcagattttaaaacatcatgcctgaagacatgtccaactttattttttatatgttatattctggtccaatatactagagtaataatactctggtattttaggatatctgtcatttgaacctcagttacaaattaaacaatagtagctaaccatatctaagtgataagtttgcatctaagatttgtcctgatgccagtttgaagatatataagctgacagaaatttgcattgtttagaatgactgtagtctaacaatatcatggttcagacaacagaaagctgaatatgcccctgtggcagcaaatattaatatgttactaaaatatgaaaactacgtttaagcaatgtcagttttataaacaacagataagatatgtacataggtgagtaagtgaaaaagtcatcagcattgacattttgggttattcacgtgaccttgattggcagcctaatcttttatttatcaagaaatctaccttttacaacttaaatattatgctttatggatatgccaaacccaagattatctttaattgaatttgaccagcgctttggtttgggaagcatgcaatgatctttaaattcagtgtgaaatgcttctgtagaattatagcagaaagcccttgctataacctggcttagtgcagacatgcaaatctgagatagcacaaccagtttggctggactaaaggtgcagatgatcagtctaaacagcagtggtgataagcagaagaattccttataattggtacagtggggttatctaacagggacaggaagggcactcactgcatctaatgaggttcaggaggtaattgaagtgtgttaaatggtcaaaggtgagacttcagtttgagcttcaacttcacttataatgacttgaaataatgtaataatgtgccatattacttagaaataacacctagctgttaagtgtcacagcagcttctgcagtgatgtgacgttattgataatgagcattttctataagaggacattggaaactgatgttgcatactcattcagaatattgtttttaatgttgaagtgaaaacacttgtacctgtaattttagtcaaaaccaaatataatgttggtctgttaaaattttctgactcaaaaaaaaaaaaaaaaaaaaaaattttctgactcacgtactgagttcaaatacgttctgggtcaggcccaagttgtatacttggagatattaatgtaggtatgtgacagatatatactttgccgtacactgtttacatcacaagtgatcgcatgaaaatattgaatgtggtataagtagcactgaaagcaatcatttttaactgttgtgtgggtagattttgcccctccattatcaaaaaaactgtattctctatttaaatgtagtcagctactatcaatccagaagaaataaatctgcatttttccatttagcctttcatattttctcacattataaccaatgactgatttattaaatcacccttcagttttactgttgattttgtttgtttgctgatacattacagaaaatattataaatatttgttttaatgaagtgtgacattgtatcacttaaatctattgtttagtaagaatatgaaaattatgatgaggtttataacacaaaataaaaccaaataatactcaaaaa

SEQ ID NO: 438710 - DNA, 263 bp, Homo sapiens
gatgaagctctagaagatgaagacaacaaaaaagatgatggtatctcattcagtaatcagacaggccctgcttgggcaggctcagaaagagactacacatacgaggagctgctgaatcgagtgttcaacatcatcttttttgttgtcttcatcttctagagcttcatctttctctagtatttcatcctcatctgggtacttaacattcttcttttaattctgggtgtcgaaggtctgggaatttagtagtattaggcgacagc

SEQ ID NO: 438711 - DNA, 311 bp, Homo sapiens
gatgaagctctagaagatgaagacaacaaaaaagatgatggtatctcattcagtaatcagacaggccctgcttgggcaggctcagaaagagactacacatacgaggagctgctgaatcgagtgttcaacatcatgagggaaaagaatccagatatggttgctggggagaaaaggaaatttgtcatgaaacctccacaagtcgtccgagtaggaaccaagaaaacttcttttgtcaactttacagatatctgtaaactattacatcgtcaacccaaacatctccttgcatttttattggctgaattgggtac

SEQ ID NO: 438712 - DNA, 2005 bp, Homo sapiens
ggaatgagtgtctttgtgtatcacctggtgacttgtcagtgtctgtgtctgtgtgtgcctgtgagccagcatctctgtatcagtgttgctcatgctgtgtctttgtgcgccatggtgtgtcagtgtctgtgtgttgatgggtggcccatgagtgacccccgccaggaggaccaggctggctggatccagcacatctccccagtggcagcctcgccctctgggtcagggtgactgaggcattttgtggccttaaaacggggtgttcagggtcagccctcagggtgctggggcccttccatcccttgtccccttcaggttggtgaaaaggactccgggggccaggtgctgtatagcagcttatggaagtctcagctgggctatcctgcccttgggagcacagacaggctcctagggtgctgagtgaagcctgaagaccaagccccctcctcctggaatgctccttccacccctacctctcagagatgggcctgacacctctttctcattcattctccttttccctgtgctctgggaaagcccctggctcaggctgtcagagtgaggatggacctcaaaagtttgatcccctcgtgcagatgaagaagctgaagcccagagtgcggaaggggagtggcccaaggtcacacagctagtttgagtagagccagtcttgggagagccaagtactacagccctgggggtgtcacaccgcttgtcactgcccctgaggtctcctgccaaacaactgcagggagtttggctaacagtcctgtgtccagggtgccggtggggatgttatagatgttgctgggatcctgccctcggctccaaattctggcctctcatcccaggctgcagacccttctgccccatgacaggcctgggtgccacacagaggtggccaccctcccaccacagtgtctgcagctgctgcccttctcccaggcccccagacagaagagaccctgtttcccctcctctcccctgtgacttcacaagagcttgggctaggagtgaaggtcagcatgttctcatgtgctcatcctcttggtttccccaaagaccgggagggtcacggatggggcgtgcagaatccttgtgttttttctcgctgggcagcttgaggggctggggagtattcccagggtctttgctctggagagtccctgcagagccactggctgaggttgggttcagggttcagcggagtcctccatgcttccaaaggccgggaagcacccgcctctctatcgagtcagtgctgtgcgtgtgtgtctgagaatgtgtgtgatgtgtggagtgtgcgtgtgtttgtgtgtgtgtgtgtgtgtgttggggcagaaggaccactctttcctggggatcccttgacccttataactagaagggaccttagggagcatctaagctggtgcccccattgtacaggcgaggtccagagggatggcatctgcccaccccaccccttgccctcttgttgcctgcactcatttcccagggaccctcctaggataggaatgccctccttcctggccccctcccgccatcctcccagccacccacataatcaccatctcagcccaactctggtggccctctaggtctccatgcattcttcctgccctagagtagccagctcaccaaggcctttatccccagcccaggagaagggtcagggagggaaggggctgcaccagccctgagacctcaaagacttgggagaaaagccaaaactcctcatgcccaggcccacatgtctgaccaccccagcccaccccgccaccaaggtaaaagcacaacaggagacccccttattaatgggtgaaatgattggggttgtttttttagtcacacagccccatcctcacccctttgccttgctgtctgtctccaccccagcctctgttccccatttgcctctctttcacctccaagcccccaaatgtaacctctagttgcggacgcggttgttctatcaataaagctgcagtgttctagcactcag

SEQ ID NO: 438713 - DNA, 2946 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438714 - DNA, 3034 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggtgaggcccctgggaatgactcctggacctccacccagtcctcggccgccaggctgcccctgaggttcacttttatttttcctcttaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438715 - DNA, 1842 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctc

SEQ ID NO: 438716 - DNA, 2852 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcaaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438717 - DNA, 1849 bp, Homo sapiens
aggtgactctaaggatcctgttagtggacttctagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438718 - DNA, 1178 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattagtaagtctatgaaacgcacgtgacgtgtgtgtggtatacagtaggtgctcaataaatgcacactgctga

SEQ ID NO: 438719 - DNA, 999 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagcaagaaggattacatggagacagtgatgtcgaggagggttggcttggtcgttatgaaatgctgaatgccccccagctccatcgagcccccttttgacagcagccccgtaaggagactgggcactgggcatttttctcactggggcttctcttccagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggtccctggagccctgatctcctctggacgccacggatggc

SEQ ID NO: 438720 - DNA, 581 bp, Homo sapiens
aggactattatttacctaagatattttatatattagtaagtctatgaaacgcacgtgacgtgtgtgtggtatacagtaggtgctcaataaatgcacactgctgaaatcctgtttctgtctttcttagatgcacctgcttcccaaggcctgaaagctgagcatctgtatattctcatcggggtctcagtggtcttcctcttctgtctcctcctcctggtcctcttctgcctccatcgccagaatcagataaagcagggtaggtctcaggggcagggtggggtgacctgggaagctgtcaggagaggctaggaagaaggtctccttaattcacaccccgactgtccttagggccccccagaagcaaggacgaggagcagaagccacagcagaggtgaggcccctgggaatgactcctggacctccacccagtcctcggccgccaggctgcccctgaggttcacttttatttttcctcttaggcctgacctggctgttgatgttctagagaggacagcaggtaaagggggaggaggagggacaggcctgggatggggaagtggggacttggtgccaatccagat

SEQ ID NO: 438721 - DNA, 387 bp, Homo sapiens
ccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggtgaggacgtcacctgggccctgccccagtctcagctcgaccctcgagcttgtccccaggtccctggaccctgtcccagctgctgtcctctgtggccaaccttgtcctcctcctgaccgccaagccctcccc

SEQ ID NO: 438722 - DNA, 936 bp, Homo sapiens
  misc_feature (25)..(25): n is a, c, g, or t
  misc_feature (29)..(29): n is a, c, g, or t
agtccagggctgtccggtctgagtngtangatagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaatgcaaaggacgaggagcaagaaagccactagcaagaatgccatgacttggcttgttgatgttctacgagaggagcagcgacaacggcaccagttcatggacttcctgagaagggaacgagagaacggacacctctggcctggctgccgggagttccgaggagtgacttatgctatggtggacccttgggcctac

SEQ ID NO: 438723 - DNA, 2895 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaaggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438724 - DNA, 2849 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggtgaggcccctgggaatgactcctggacctccacccagtcctcggccgccaggctgcccctgaggttcacttttatttttcctcttaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438725 - DNA, 3162 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgatactgaagatgtgtctcaagctagtccatctgagtcagaggccagattccgcattgactcagtaagtgaaggaaatgccgggccttatcgctgcatctattataagccccctaaatggtctgagcagagtgactacctggagctgctggtgaaagaaacctctggaggcccggactccccggacacagagcccggctcctcagctggacccacgcagaggccgtcggacaacagtcacaatgagcgtgagtgatgggggccgtggagcatgaagctggtgtgtgcctcttggggaaggagaaagaggtcaggctttggggttgatcagattcctgctctgccaatggcagtctgtgtccctgtgcagaggactccagcactcaggaccccggtggtggaagaaggggataacgatccctgtactgcaggactattatttacctaagatattttatatattaatgcacctgcttcccaaggcctgaaagctgagcatctgtatattctcatcggggtctcagtggtcttcctcttctgtctcctcctcctggtcctcttctgcctccatcgccagaatcagataaagcaggggccccccagaagcaaggacgaggagcagaagccacagcagaggcctgacctggctgttgatgttctagagaggacagcagacaaggccacagtcaatggacttcctgagaaggacagagagacggacacctcggccctggctgcagggagttcccaggaggtgacgtatgctcagctggaccactgggccctcacacagaggacagcccgggctgtgtccccacagtccacaaagcccatggccgagtccatcacgtatgcagccgttgccagacactgaccccatacccacctggcctctgcacctgagggtagaaagtcactctaggaaaagcctgaagcagccatttggaaggcttcctgttggattcctcttcatctagaaagccagccaggcagctgtcctggagacaagagctggagactggaggtttctaaccagcatccagaaggttcgttagccaggtggtcccttctacaatcgagcagctccttggacagactgtttctcagttatttccagagacccagctacagttccctggctgtttctagagacccagctttattcacctgactgtttccagagacccagctaaagtcacctgcctgttctaaaggcccagctacagccaatcagccgatttcctgagcagtgatgccacctccaagcttgtcctaggtgtctgctgtgaacctccagtgaccccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438726 - DNA, 1865 bp, Homo sapiens
atttctatggctcccatttgtaatacaaggaaatgtcagcttctagttttgtaacgtcttgcccaagagctgcgaccgttaacttgtggagttgggacggcgtccaagtcaattggttgcccgacctttattctgccttgtcccatagatttagaaagaggctgacacatctggtaactagtttacggtcatctgcctctaagcgacatttagggtaagcgacatttttcagaaaccaaggccctccctctcgtctcactagtgggaagggtggaaagaacaggacagaaagctcttcctcttgtgtgaggcagttgctgtggaagccccataggcaggaggcccccgggcagcacatcctgtctgcttgtgtctgctgcagagttctgtccttgcattggtgcgcctcaggccaggctgcactgctgggacctgggccatgtctccccaccccaccgccctcctgggcctagtgctctgcctggcccagaccatccacacgcaggaggaagatctgcccagaccctccatctcggctgagccaggcaccgtgatccccctggggagccatgtgactttcgtgtgccggggcccggttggggttcaaacattccgcctggagagggagagtagatccacatacaatgataccagagactttgctgtaattatctgccctgctgaccctaaagaccttcctagaagtcaagagctagccttgagactgtgctatacacacacagctgagagccaagcccagttctctgggttgtgctttactccacgcatcaataaataattttgaaggcctcacatctggcagccccaggcctggtcctgggtgcataggtctctcggacccactctctgccttcacagttgttcaaagctgagtgagggaaacaggacttacgaaaacgtgtcagcgttttctttttaaaatttaattgatcaggattgtacgtattcaaggtgtaaaatgtgataatttgtcgtacacgtacattgtgcaatgacagtcacaatcaattcctcagcgcacccatcgccacggatacgatacattagatattctgaacttgctcatcttaggacttcacattggtgtcagtgttttctgacaaatcacgtgtatcaggaatgaatgagggaggtgtggctgggtgaaggcagagagccgaccctacaggtccacatctgcacatacatgcacaggaatgcatgctctcacacacatgcatacacacacgcacacacacagacatgcacatacactcacacgccccaggaaatccaaggaatcactgagcctgctgttggttgaggcatttctgagtatccaccctacctgtagggtcagatgtactgattgacacagaaaattaccctatgtaccactaggaggcggcagaatctcatttgggttaatctgtgtttgtctttaaaaaacaaaaacaggccgggcatggaggctcacgcctgtaatcccagcactttgggaggctgaggtgggcggatcacgaggtcaggagatcgagaccatcctggctaacacggtgaaaccccatctctactaaaaatacaaaaaaattagccgggtgtggtggtgggtgcctgtagtcccagctactcgggaggctgagggaggagaatggcgtgaacccgggaggcggagtttgcagtgagccgaggtggtgccactgcactccagcctgggcgacagagcgagactccgtcaaaaaagaaaagaaaagaaaagaaagatttttaagaattcagcaaaaactcagccagctctttctatggggcagttgctaatttagttctaggcaaacgtggacacattaaattctcctacaaaccct

SEQ ID NO: 438727 - DNA, 461 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 438728 - DNA, 1834 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 438729 - DNA, 1817 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggacccactccatggtttatctcatcccgttctgtccacagttccatagagggttcttctccaaaacaaaacaaaa

SEQ ID NO: 438730 - DNA, 1579 bp, Homo sapiens
ggagaggcttatgactttggggaagggtcctgtgggtatgaaggaaggaaaaggggctgtggttaagtgggctgggggcagagtggtttggggtcatggggggtcgccgagctcccctaaaacgccgccttctcagcaaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 438731 - DNA, 1609 bp, Homo sapiens
ggagaggcttatgactttggggaagggtcctgtgggtatgaaggaaggaaaaggggctgtggttaagtgggctgggggcagagtggtttggggtcatggggggtcgccgagctcccctaaaacgccgccttctcagcaaccctcaagaatcgacccatcaggacgccagagctgcttcagcggtgaccaccttctccctctaacacattcttcccttcttcacaaacggcccatgtcactcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatc

SEQ ID NO: 438732 - DNA, 1191 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcatgactgataggtgctcaaagagagaaatagccagcctagcccctatgctgctagccccctgtgcctacccatgtggtttgcttcttcatgtggtgtgcagtgctgtgctgtgctgtgctgtgctgtgctggtgtcttctcttacatgtctttgggagtgtgctatctagatgaggtcatagtattagcccctggatttcctccgccagtctgtcaatatgtctacccctatgtagtgtctatgaatgctgttaggtcactaatagtatagatagcctatatacattcgcaagtcctgtagtggtctattcttaagtgactgtagttgcctagtgatgatcgccctatccctatctcaaagtgatagtcgctgatattaatgagtgtaagacagaagatggtagatattctgatttgcatgattctagtggctaaattctgttaagttcggtattcgtcagtaagtgatctaaagttctaaatctcccatttctctattatgatcgcgcggttgtctttgtgtttatcttactttactaagtgtaagccgcttggttacggagttattctttgcggtcctatttcccattctctcttttggtgtatgtctgaaatagcttgtcttcgacctccgccacaaacccccccttggcaacaaatcgcgaggaatgtgacttggtgcctaggcggccaacgacc

SEQ ID NO: 438733 - DNA, 1838 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatc

SEQ ID NO: 438734 - DNA, 1725 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 438735 - DNA, 1926 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcaagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctccttcactgccgcctttgtcatctcctttggagggtgcatgggggacgggaggaggggcacgggtttaagggacttggggagccactggaagaataataaaagtgttgctctttatc

SEQ ID NO: 438736 - DNA, 1939 bp, Homo sapiens
gtcagacctgggggcggggcacacgttagaagaggggtggagcttgcaaaagtatcgggggcgggactcgctgaggtgcgaaaactgggccagggcagggctttgaccagctacttgagcgtgaaggggcggcgcccgcacgaaggggcgtcccagcttggaggcggggcccggatgggaggggcggggccgagtgcagtatcccgccaggtgagaaggggataagagtcgggcaagcagcttcagccgcaaccacggcacgaagttgggtgggtacgcctggcacttccgggtgaaaccgtgcgtatttccggttaagatggcggcgcccagcagagtcaggtgcggacgactttgtctgtaggagcagcggcggcttgaggacccggggaggtgagatccgccttattccggcgcccctcttcggagaggagggagaagacttgttgctaaggagaccaaagggcgggcttgttgctacggaggcggagcagtgagaccctcaagaatcgacccatcaggacgccagagctgcttcagcggtgaccaccttctccctctaacacattcttcccttcttcacaaacggcccatgtcagacgaaggctcaagggggagccgcctgcccctggcgctgcccccggcctcccagggttgctcttcagggggcggcggcggcggctcctcggctgggggctcgggcaattcccggcccccacgcaacctccaaggcttgctgcagatggccatcaccgcgggctctgaagagccagaccctcctccagaaccgatgagtgaggagaggcgtcagtggctgcaggaggccatgtcggctgccttccgaggccagcgggaggaggtggagcagatgaagagctgcctccgagtgctgtcacagcccatgccccccactgctggggaggccgagcaggcggccgaccagcaagagcgagagggggccctggagctgctggccgacctgtgtgagaacatggacaatgccgcagacttctgccagctgtctggcatgcacctgctggtgggccggtacctggaggcgggggctgcgggactgcggtggcgggcggcacagctcatcggcacgtgcagtcagaacgtggcagccatccaggagcaggtgctgggcctgggtgccctgcgtaagctgctgcggctgctggaccgcgacgcctgcgacacggtgcgcgtcaaggccctcttcgccatctcctgtctggtccgagagcaggaggctgggctgctgcagttcctccgcctggacggcttctctgtgttgatgagggccatgcagcagcaggtgcagaagctcaaggtcaaatcagcattcctgctgcagaacctgctggtgggccaccctgaacacaaagggaccctgtgctccatggggatggtccagcagctggtggccctggtgcggacagagcacagccccttccacgagcacgtgcttggagccctgtgcagcctggtgacagactttccgcagggtgtgcgcgagtgtcgggagccggaactgggcctggaggagctcctccgccaccgctgtcagctgctgcagcagcatgaggagtaccaggaggagctggagttctgtgaaaagctgctacagacctgtttctccagcccagcggacgacagcatggatcggtgaaaccaggtggcttcttgcccccttctccgtgggaaccccaggcctcttgcctccctccccacctacaaggccctctcccaagggatcgcagggcctaggtgcctggacccagggtgtgccagcccgtctctgtgcagtccctggaaggggcgctgagaaaggcaccagctccttggaccccacctcccatgctctcactctcatccccgttctcttgtccacacagctcttccaataaaggtgtttctcttcctccttctcctcctt

SEQ ID NO: 438737 - DNA, 3863 bp, Homo sapiens
  misc_feature (2192)..(2192): n is a, c, g, or t
gccccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctgggacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaattaaa

SEQ ID NO: 438738 - DNA, 1953 bp, Homo sapiens
  misc_feature (282)..(282): n is a, c, g, or t
gtaccaacttaggtgcgagctgctaactcaggcgcgagctgctaactcaggggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctgggacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaattaaa

SEQ ID NO: 438739 - DNA, 2939 bp, Homo sapiens
  misc_feature (2227)..(2227): n is a, c, g, or t
gccccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccgtgaagccctgggcccacttcccaagaatctca

SEQ ID NO: 438740 - DNA, 3898 bp, Homo sapiens
  misc_feature (2227)..(2227): n is a, c, g, or t
gccccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctgggacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaattaaa

SEQ ID NO: 438741 - DNA, 2603 bp, Homo sapiens
  misc_feature (35)..(36): n is a, c, g, or t
  misc_feature (932)..(932): n is a, c, g, or t
gaccggcgagatagcaggaaggaatacaggacagnnccacgcgtctcctcggtccgcacataggtgcaaaaccgctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaagctgtgtgtctgtttttatctcccctctcaggaccagtcagccactggtcaatcaggctgatcatggaacattaggaattctccaattaagggagaaaaagtccagggacttagttatatcttcagaccagtgcagctgggacacacaaagttctcctgtctcaccatctgatatggtttggatgctcgtcccctccaaatctcatgttgaaatgtaattcccagtgttggaagtggagcctggtgggaagtatttggatcatgagagaggatccttcatgaatggctcagcaccatctccttggtgatgagtgagttctcactcaattcacatagatatggttgtttaaaagagtctgagacctctcccctctttctcgccatgtgatatgcctgctcccccttcaccttccgcctttactgtaagcttcctgaggccctcaccagaagctgagcaaatgttggtgccatgccagtacagcctgcagaattgtgagccaaaataaatgtcttttctttataaattaaa

SEQ ID NO: 438742 - DNA, 3754 bp, Homo sapiens
  misc_feature (2227)..(2227): n is a, c, g, or t
gccccagctgtgaccagagcaaccagagcctgccacccgacgcaaccccaggctcactcgctcacccccctgggccctcctgcttccggccgggggcaccatggcctgccgctcctgcgtggttggcttcagcagcctcagcagctgtgaggtgaccccggtgggcagcccccggcctggaacctcaggatgggacagctgcagggcccccgggccgggcttcagctcccgcagcctcacaggctgctggtcggctggcactatctccaaggtgactgtgaaccccggcctgctggtgcccctggatgtcaagttggaccccgctgttcagcagctgaagaaccaggagaaggaggagatgaaggccctcaatgataaatttgcctccctaattggcaaggtgcaagccctggaacagcgcaaccagctgctggagacacgctggagcttcctgcagggccaggactcagccatcttcgacctcgggcatctctatgaggaatatcagggccggctgcaggaggaactgcgcaaagtgagccaggagcgggggcagctggaggccaacctgctgcaggtgctggagaaggttgaggagtttcgaatcaggtatgaggatgagatctccaagcgcacagacatggagttcacctttgttcagctgaagaaggacctggatgcagagtgtcttcatcggactgaactggaaaccaagttaaaaagcctggagagcttcgtggagttgatgaaaaccatctatgagcaggagctgaaggacctggcagcacaggtgaaggatgtgtcggtgaccgtcggcatggacagccgctgccacatcgacctgagcggcatcgtggaggaggtgaaggcccagtatgacgccgtcgcggctcgcagcctggaggaggccgaggcatactctcggagccagctggaggagcaggccgcccgctcggccgagtatgggagcagcctccagagcagccgcagcgagatcgcggatctcaatgtgcgcatccagaagctgcggtcccagatcctctctgtcaagagccattgcctgaaactggaggagaacatcaagacagctgaggagcagggtgagctggccttccaggatgccaagaccaagctggcccagctggaggccgccctgcagcaggccaagcaggacatggcgcggcagctgcgcaagtaccaggagctgatgaacgtcaagctggccctggacatcgagatcgccacctacaggaagctggtggagggcgaggagggcaggatggactcgccctcagccactgtggtcagcgctgtgcagtccaggtgcaaaaccgccccttccctcccctaccccttatgttccctgtagctgcctccagatcaggcctctccaaggccccctcccgaaagaagaagggcagcaaaggccccgtgatcaaaatcaccgaaatgtcagagaagtacttctcgcaggagtcggaggtctcagagtaaggcggctggaccccaggaaccccagggcactccactgcagcaggagggacttaagctagactcaagaaagcagcttggagcctctaggttgagaagagaggcaaaacctgatattgaactgagagaggggttcaaaactgactgtgttttgtgggctgccagggtgggagaggagcatcaccagctcctcagagccactccgctccatatcagtatctcacagtcccatccttccaaccttctggccagaggttttcctgatgggtgagtcggaattaggggtcagttttgtctccacctcctcgctcctctgaggctcctcctccagcatcaggctctgccaaggcccctctgactcttgcccaatccttgaccttgactcctatctcaagccttgccttgtctctgcctcggaactgggactgggactggctcatccacctatgtgcgggagccgaggaggacggcgtgggccctgtcctgtatctggaattcctgggaaggctggctgctgaagaccctcttggctttcccgtgctctttgggctccccagagacctgacagtattagggagtgaagggaggaggggccctggctatttgggacctaagcctaggccccagagatcagcccgaacacccgcatcccttcctcctcccatgggtccctcccagtaggcagtagtcagaactggatgggctgcccccagccagctcccagcagcttctccgnaagctgctcttgccataatcaactccctgggagtggaagccagatggcagcttgagattgggcaggagcattcgatcttcctttcacctccctgccatgctggggtcctacccagcctggatctgagctctgtgcccccagccgggttgttcccagcctgagcaccgggctttggtgcaccaggccttggagacccctggtcccacccctgccgtgaagccccaggcccacttcccaagaatctcacttctcagggcctctgttctcctctccactgggccaaatagcctggccctcccctccttggcattcatgggggagcccaggaaccccccacacctatggggttagagctcctcctttcttctcactccttccccttcctccctccatgcccactccccctgcctccagcaggccaggaagaaggcacagtccaggcaagtctgggagcttccaagcccttgaggtccagctgtggggcccaaatgacagccttacaagggttctaccagagaggaaaattccacatcccaccagaagacaggggtgttggcaggcatactcctatctcctcctcttggctctcaatgctgaggcttgcagaggcatcccagcggcaccagcctcccactgcacagcttccttccctccttcactctcctctcccctccctgccccttgcctcacctcctcttctagactgcattagattcattcatctcattttccaggacatgttggccagaggtctgggcccatcccaggcctcaaggccctccaggcctgtggggagcactggagggttactgactctctggccatgggaactcagagattctcatccccaaagtcccaaaagagggtgctgattggtgcttttcctcaggctcttcattggtttccaagggagcaaatcctcagtggggatacaagacatataaagtatatattattttttcataacttatgtggcttttaacttattgcttcccttcctgtttctgcatgatcagtctgtatgtactatctggaaagataacacatactccagccacctcacctgattggctatcttggggccatgtccccttcttgctgccacaggatgaataaagtgttgagatttgtctatggagaaaaaaacaaaaaaaaaaaacaacaaaaaaaaaacaaagaaaaaaacaaaaaaaaaacaaaaaaagcagggggggggcgccgcccacagagagagtctccccccggggggcccccacagtcccgcgcgccgccccccgagtcgttctagtgtgagaacacaagggggggcccccccaagaaagaggggcggccacgaatactaatgagaaaaacgaagaggagccggagggcgcagcgagtgattaaaaaaaacacggcgtgcgggccgacgacgcgggcaacacacacagcgcgagcacaagtcctgcgagggagaccactcgtgggggggcgaaagagcgagcccccctcacacaccaaaccgaggggaggagggggggagacaca

SEQ ID NO: 438743 - DNA, 369 bp, Homo sapiens
gtggaggttgcagttagccgagatcgcggcattgcactccagcctggatgacagagagagagactccgtctcaaaaaataataataataatagaaaagaaaaggaaggatgctccagcgctcctgaagtcctcccagcaaaagaaagggctgcccagcacaccctgccatagcaaccgtgcttttcggtcatccgtggttctccacggcagaattccaggcatccccgggccctctcctctctcttcccttctctattcaggaaacggtctctcctctcccaccttcacttgtcgcgaaggccatgtttctctttggcttgtcctcatagaggtggaaaacagcaggtttctaacctctgaactaccct

SEQ ID NO: 438744 - DNA, 557 bp, Homo sapiens
cggacgcgtgggtcgacccacgcgtccgattaaaggcgtcgcctcgcccctcgccttcctctttccgtctcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438745 - DNA, 174 bp, Homo sapiens
ggatttgctggtgcagtacaactaggcttaatagggacatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438746 - DNA, 547 bp, Homo sapiens
aagacgccccaacagccccacccacaggttcacccaattacggctaggtacgaggcgggtggtggcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438747 - DNA, 746 bp, Homo sapiens
cggacgcgtgggtcgcccacgcgtcgcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaacaaaaaaaaaggggccgggccgatcagataacgctcctcatattaggcctattaaccaacaattaaccatttaccaatgatgggcgcgatgtaccacgagacagcacataccagggcaccaaacaacaccttgtccaaaagggctcagaacgggataatcctattatacctcaaaaagtttttcctcgcaggatttctgggcctttaaccatccaggctagcctatccc

SEQ ID NO: 438748 - DNA, 195 bp, Homo sapiens
gcggccgcctactactactactactgctcgaattcaagcttctaacgatgtacggggacatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438749 - DNA, 511 bp, Homo sapiens
gtggatcccccgggctgcaggcggcacgacgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438750 - DNA, 395 bp, Homo sapiens
  misc_feature (3)..(4): n is a, c, g, or t
  misc_feature (6)..(7): n is a, c, g, or t
gcnncnnctactactactactactaaattcgcggccggtcgacaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438751 - DNA, 773 bp, Homo sapiens
  misc_feature (3)..(4): n is a, c, g, or t
  misc_feature (6)..(7): n is a, c, g, or t
gcnncnnctactactactactactaaattcgcggccggtcgacaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaaaaaaaaaaaaaaaaaaaaaaaaaagaaaaaaaaagaaaaaaacaacgagaaggcggaaaacagaaactacagaaagcagcgcacgagagaggaaggaacagacaacgaacaaaggcaaacagaactacgacgagcgggacgagaagaaggtaagaacgaacgaaccagaggccgcgcaaagtacaccagaggaagggaggagagggagcaacaacctcagggggggagcacacagcaggagcaacaccgaaaccgcgagagcaaagcgcgagaacaaagagaacaaggacaaggcggaaacacgacgacaagggcgcaagaaggaggagagaagaaaaaaaaaggaca

SEQ ID NO: 438752 - DNA, 896 bp, Homo sapiens
  misc_feature (644)..(644): n is a, c, g, or t
  misc_feature (648)..(648): n is a, c, g, or t
cggtgacacaactaggctaggtacgaggcctgggtgttggcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaacaaagaaaaaaaaaaacaaaaaaaaacaaaaaaacagaaacaaaaaaaaaaaaaaaaaaaaaaaaaaaagggggggggggggaaaaaaaaaccgaggggggcncaanatatagcgaccacacaccttcgtgggagagaagaggccgccacacagcgagggtcatacaacaaaacagcgggcggcgcgccgcaaaaaaacacggcgcggggggcacaaacgtcagcgtggctatctgggagaagacccctgccggcggggagcgacacagcgagacccccccgagcaagagacgcggggcgaaaaactggtccgttggcgcacacccgcagtcggcgcgaacgcgccggttacaaa

SEQ ID NO: 438753 - DNA, 921 bp, Homo sapiens
gatggtgacagaaagcctcatgagagaaacacatgagaactggtgtccttttttatcaggtcctcctccttgttgtataaagtactgctccaagttatcacagtcaattttggttctacagaagataattgcttgatccatcttatgttccttgattgcccggacagcatactcccctttcaggattttaatagcttcagaccacatctctggactattagcaccaggtcttgtgttatcttttgcatgtacatcatcagttctaatgtggctctttccaagcctttcccgtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaacccgggtccggggggggggggggggaaaaatccggggaaatcggggggggaccaccgggtttttgggcaacggttcttgggccccaaaaagggcaaggggaaaacgggccgggggaa

SEQ ID NO: 438754 - DNA, 1334 bp, Homo sapiens
cagggagctgatggggtgtgacaggcacaccataggctggaggcacaggtggagggcagggaagaggaccggcaaatctatagaatcctaaagggagccaagagaagccacatgcaaatctccctccctccaaacaattctcccttagagggcatccgcgctcccctggggtggcagtcagcgagaagtttccgtgtaggttctccccaggcttaaacagtttaagagttttatttcaagaaaaccctggggagggcgaactgcaagagggctgccaggattagccgagggattccgaatgaagacggagtatttccgaacatacacacctctcccaagagcgtttccggagggttccgaaaatacccgagcgggcctcggcgccctcattggccatcaccgcgagggcttacgaagaccggaaatatccaaaggtgccggggctaggcttatatagttcacgcattcaccagttcattcataaaacaaatgtttgttgagcgcccatcatatgccaatcacagtgacaagtgctgggtgagcaatactggagagataacgctgaggtatgggtcccaggacctctcgaattggagccactcggaaatccagcggtagagtttcgaaaacttccgaacggttcccggaatacgctctcggccctctaaccgaagagttccgaatattcccgagcgttgagcgaattgtcggcggaagcagccgaacatcatcgagccgcctcggaggtggggaccgacaactcctgtcgtgcccgccggagaggaagcggaaatgcgtgtacggtattaaaggcgtcgcctcgcccctcgccttcctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438755 - DNA, 514 bp, Homo sapiens
  misc_feature (41)..(41): n is a, c, g, or t
agcgactaaggctagggtacgaggccgggggttaatcggcngagggggagccgcgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438756 - DNA, 388 bp, Homo sapiens
aaagcaggctggtacaggccggaattttcgggatataattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438757 - DNA, 522 bp, Homo sapiens
cggtgacacaactaggctaggtacgaggcctgggtgttggcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438758 - DNA, 556 bp, Homo sapiens
accaccaccacacaacaccgcccccccccccccacgacgaacataggtcagtacaggccttgggtgttgcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438759 - DNA, 405 bp, Homo sapiens
  misc_feature (396)..(396): n is a, c, g, or t
  misc_feature (403)..(403): n is a, c, g, or t
cagtggagatgaagcctaagaatatgatcaggtaactttcgaccgactttccccaagagaaaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagncagctgnct

SEQ ID NO: 438760 - DNA, 516 bp, Homo sapiens
attaaatcccccctatgcaccttttattttaagatttgttggttaggtaattggccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438761 - DNA, 308 bp, Homo sapiens
  misc_feature (25)..(25): n is a, c, g, or t
agaggatcccctgtagtgctctggnacgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgcccacaatccaggcgcccacaa

SEQ ID NO: 438762 - DNA, 321 bp, Homo sapiens
cggtacccgatcaaaccttttatgttgctgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcacagcaacataaaagggtttgatcg

SEQ ID NO: 438763 - DNA, 683 bp, Homo sapiens
  misc_feature (19)..(19): n is a, c, g, or t
  misc_feature (32)..(32): n is a, c, g, or t
  misc_feature (57)..(57): n is a, c, g, or t
  misc_feature (311)..(311): n is a, c, g, or t
  misc_feature (643)..(643): n is a, c, g, or t
  misc_feature (645)..(645): n is a, c, g, or t
  misc_feature (650)..(650): n is a, c, g, or t
  misc_feature (654)..(655): n is a, c, g, or t
ccccggcatgtgctgtagnccagcgagaagtnccacagcgacgatgcggtgcgccgnctgtgggtgtccgtccatgccacggcacacagcgcgatggggtggtcggggatgacatggatgtcggtgatgcgctgttccagcagcaggtcttcggcttcgaagcgtcgggtcatgtagggcgccgtcagggcaaaagaaaaggggcggacccgcacctggcgagccgcccccacgacctgcggcttaacgctgctggcggttgccgccctgctcgcggttcgagccttcgttgccgcggttggcctcttcangctgtacatcgagctcggtacctggcgatgtcgcgtgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatggcacncngacanagcnnggtacagagctcgattcgtatatgtcat

SEQ ID NO: 438764 - DNA, 750 bp, Homo sapiens
cttagaggatccccaagttagtcgggacgcaagtatgtcgggacgtacttgctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgtacacaataaaaaaaaaaattctccaagggcg

SEQ ID NO: 438765 - DNA, 352 bp, Homo sapiens
gcttcaggtgccgctgcgaaggtgcgcgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtgggccggcagccgacggcaaaggtgatcttgaggtgatcttctgcacgataaggtgatcttctgcacgacgaggtgatcttctgcacgataaggtgatcttctgcacgatgaggtgatcttctgcacgataaggtgatcttctgcacgataaggtgatcttctgcacgat

SEQ ID NO: 438766 - DNA, 536 bp, Homo sapiens
aggatccttaattaaattaatcttccccccccccccgctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438767 - DNA, 4275 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438768 - DNA, 561 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438769 - DNA, 949 bp, Homo sapiens
aggatccttaattaaattaatcttccccccccccccgctctttccgtctcaggtccccgctttccgtctcaggtcaggtcgccgctgcggagggagccgcctgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438770 - DNA, 3949 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttata

SEQ ID NO: 438771 - DNA, 688 bp, Homo sapiens
  misc_feature (581)..(583): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaannngggggggttccttttaaagcccccctgagggattcaaattttgaaattggccgtttttttaccccgggaaaaatttttgcccttttttgcttttcccttgggggg

SEQ ID NO: 438772 - DNA, 930 bp, Homo sapiens
  misc_feature (678)..(678): n is a, c, g, or t
  misc_feature (682)..(682): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaacaaagaaaaaaaaaaacaaaaaaaaacaaaaaaacagaaacaaaaaaaaaaaaaaaaaaaaaaaaaaaagggggggggggggaaaaaaaaaccgaggggggcncaanatatagcgaccacacaccttcgtgggagagaagaggccgccacacagcgagggtcatacaacaaaacagcgggcggcgcgccgcaaaaaaacacggcgcggggggcacaaacgtcagcgtggctatctgggagaagacccctgccggcggggagcgacacagcgagacccccccgagcaagagacgcggggcgaaaaactggtccgttggcgcacacccgcagtcggcgcgaacgcgccggttacaaa

SEQ ID NO: 438773 - DNA, 677 bp, Homo sapiens
  misc_feature (567)..(567): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctaaaaaaaaanccaaaagcaaacaatttaaatcttgaggcggtgcccagaaccaaataggacctaaggtgagcccgtttacattctccgtagaggggtagatttctatccttggctctttc

SEQ ID NO: 438774 - DNA, 789 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaacaaaaaaaaaggggccgggccgatcagataacgctcctcatattaggcctattaaccaacaattaaccatttaccaatgatgggcgcgatgtaccacgagacagcacataccagggcaccaaacaacaccttgtccaaaagggctcagaacgggataatcctattatacctcaaaaagtttttcctcgcaggatttctgggcctttaaccatccaggctagcctatccc

SEQ ID NO: 438775 - DNA, 770 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaacaaaaaaaaaaaaaaaaaaaaaaaaaaaaaaaaaaaagacacggcggaggagcaacacatgtgggcggggcgcgagagaaagagaggtacaatgaaggggcacgagggggaacagagggacaccgcaccccacttcttgtcacacagggggacactacgggggccccccatagggggcagataatcagacaacacgtgtgccgcaatag

SEQ ID NO: 438776 - DNA, 553 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataagtcgcgtgcctatccct

SEQ ID NO: 438777 - DNA, 799 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaacaaaaaaaaaaaaaaaaaaaaaaaaaaaaaaaaaaaagacacggcggaggagcaacacatgtgggcggggcgcgagagaaagagaggtacaatgaaggggcacgagggggaacagagggacaccgcaccccacttcttgtcacacagggggacactacgggggccccccatagggggcagataatcagacaacacgtgtgccgcaatag

SEQ ID NO: 438778 - DNA, 638 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaagaggggggcccggtacccaattcgcctattaggggcggtttacacattactgg

SEQ ID NO: 438779 - DNA, 744 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaaaaaaaaaaaaaaaaaaaaacaaaaaaaaaaaaaaaaaacgaggggggaaaattatggggggggggggagaaaagagaagaaagagggaggaggggggaaaaaggtttggcgacccacattttgaggcaaaggggggaagagaggggggccata

SEQ ID NO: 438780 - DNA, 706 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaaacgccggggacccggccccccaacccaaaggagcttcccttggaaggcccccccttggcccccccaaggaaggcaaattaaaaggttcaaggcttgggctttttctcaaaaataaacagaacaaagaaaaagaacaaaaaaaaaggcacgaccaggaaaaaaaccaccgtgcagcagcacaaaaaatgggggggcccccaataaacccccccgggcgggcc

SEQ ID NO: 438781 - DNA, 827 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaagaaaaaagaccggggcgcttcgagagatgcgcgttactcagaagtcgaccgagcgtgctcatccggaagctgccctcccagaggtgggcgagggagatcgcgcggatttccaaaaccgacctgaggttcagagcgcagccatcggtgcgctgcagaggctaacgaagcgacccgggggcctgcccaagatccacccgggtgcaccacgcagagagccccatggccaaaaccagggccccgacagggaaaccaagagggt

SEQ ID NO: 438782 - DNA, 964 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438783 - DNA, 609 bp, Homo sapiens
  misc_feature (555)..(555): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgcagttcaaaccacacaaactccagcctgtgggagagggatccttcatcctggacgcacctgccctctgcccagccactataaaaaccagagccacgtgccccttcttttngcttgagtgtgggccctgctgtccccagaaagcctcatttacccacactttcca

SEQ ID NO: 438784 - DNA, 638 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttata

SEQ ID NO: 438785 - DNA, 750 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438786 - DNA, 756 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgtacacaataaaaaaaaaaattctccaagggcg

SEQ ID NO: 438787 - DNA, 831 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgcttgcgggaagggttgggaggcagcaggctgtaagcagcctggagcaccagcctagaccaggacgcctccacctcagcaacaccgcagccaggtcattctgtgtcatggagccatctcgtacgctgcaggatttgggcagcacccttggcctccacccactagatgctagtggcacccccgagttgtgacaaccctttctggtctcctgacaatgcataataccccttggggggcaaaatcacctctggctgagaaacactggtttatgaaccctatcgctattaaaaaaccactgaactgtatactttggaactgagttttacggcatgtaagctcagctttagcaaaaaagcctctaatgagaccccatctctgcaaaccataaaaatataaaaactaaaaaaaaa

SEQ ID NO: 438788 - DNA, 423 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatggcacgcgacatcgccaggtaccgagctgatttattg

SEQ ID NO: 438789 - DNA, 5457 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgattttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438790 - DNA, 5511 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438791 - DNA, 4364 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtgggccggcagccgacggcaaaggtgtcgtggtggtcattaagcggagatccggccagcggaagcctgccacctcctatgtgcggaccaccaagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438792 - DNA, 1738 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgattttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438793 - DNA, 4273 bp, Homo sapiens
  misc_feature (190)..(190): n is a, c, g, or t
  misc_feature (194)..(194): n is a, c, g, or t
  misc_feature (198)..(198): n is a, c, g, or t
  misc_feature (202)..(202): n is a, c, g, or t
  misc_feature (266)..(266): n is a, c, g, or t
  misc_feature (294)..(294): n is a, c, g, or t
aagacgccccaacagccccacccacaggttcacccaattacggctaggtacgaggcgggtggtggcgccgctgcgaagggagccgccgccatgtctgcgcatctgcaatggatggtcgtgcggaactgctccagtttcctgatcaagaggaataagcagacctacagcactgagcccaataatcttgaangccngcanctcncttccgctacaatcggactgaattcaccgcaagactgttggcgttgagccagcgcagccgacgncaaaggtgtcctggcttggcaaaacccntagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438794 - DNA, 1870 bp, Homo sapiens
  misc_feature (1763)..(1765): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggtgagttttgtctggtttgggccagagagcggcccctttcccgggtctgggagctgtgattttttactgtcaggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgattttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaannngggggggttccttttaaagcccccctgagggattcaaattttgaaattggccgtttttttaccccgggaaaaatttttgcccttttttgcttttcccttgggggg

SEQ ID NO: 438795 - DNA, 549 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccaccccaaaaaaccaaaacccccacccacccccacaacaacccaaaacccccccaagaaaagaagaatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438796 - DNA, 344 bp, Homo sapiens
  misc_feature (256)..(257): n is a, c, g, or t
  misc_feature (262)..(262): n is a, c, g, or t
  misc_feature (264)..(265): n is a, c, g, or t
  misc_feature (267)..(269): n is a, c, g, or t
  misc_feature (271)..(271): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtgggcnngcatncnngnnnanggtggtccgcacataggaggtggcaggcttccgctggccggatctccgcttaatgaccaccacgacacctttg

SEQ ID NO: 438797 - DNA, 307 bp, Homo sapiens
aagacgccccaacagccccacccacaggttcacccaattacggctaggtacgaggcgggtggtggcgccgctgcgaagggagccgccgccatgtctgcgcatctgcaatggatggtcgtgcggaactgctccagtttcctgatcaagaggaataagcagacctacagcactgaggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438798 - DNA, 604 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtgggccggcagccggcggcgttggatgcagtcagcggcgttggatgcagtcagcggcgttggatgcagtcagcggcgttggatgcagtcagcggcgttggatgcagtccgcggcgttggatgcagtcagcggcgttggatgcagtccgcggcgtgggatgcagtcagcggcgttggatgcagtcagtcggcggcgttggatgcagtcagtcggcggcgttggatgcagtcagtcggcggggttggatgcagtcaggcggcgttggatgcagtcagcggcgttggatgcagtcagcggcgttggatgcagtcagcggcgttggatgcagtcagcggcgttgggcagtcag

SEQ ID NO: 438799 - DNA, 873 bp, Homo sapiens
  misc_feature (597)..(597): n is a, c, g, or t
  misc_feature (599)..(599): n is a, c, g, or t
  misc_feature (627)..(627): n is a, c, g, or t
  misc_feature (646)..(646): n is a, c, g, or t
  misc_feature (719)..(719): n is a, c, g, or t
cggacgcgtgggtcgcccacgcgtcgcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaccccggggcatcaagtgcgggggggggaaaaaggggacggaaggggcccggggccaaangnggttcccgggacccaagttttctggtcncacagggggtaaaaccggncgggacccccaaaaagggggccggaataaattccgaaaaccccgggtaacctggcttaggagcccgggaaagncccccggactacaccccgctaataacgacggaatcaggggacaaggacttgctgcagaccaacccagcaaggaaccgcgggccgagcaagcgatgcagcacaccgcagtgagcacgaacagccaaaacaccagagcaggacgacgcagacagtg

SEQ ID NO: 438800 - DNA, 870 bp, Homo sapiens
  misc_feature (586)..(586): n is a, c, g, or t
  misc_feature (597)..(598): n is a, c, g, or t
aggatccttaattaaattaatcttccccccccccccgctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaaaaaaaaacggggggtttttnggggggggggnnaaaagggttaataaaaagcgaccagttggtccctaatgtgtttttcgcgacccgcgtttttcttgtcaacaggcgtgaaatcacaggggccccccaaaaggagagcgcatataaatttcgaaaccgcgcgttacctgtttattgttttcacgcacaacacaaagatggaaagagcacaaacgacactgagaacgggacgataacatgtgtacacaccatggaacacaaccacaccacagaacaatgactcatactcaaccgcacagtaatac

SEQ ID NO: 438801 - DNA, 837 bp, Homo sapiens
  misc_feature (29)..(30): n is a, c, g, or t
  misc_feature (35)..(36): n is a, c, g, or t
  misc_feature (40)..(41): n is a, c, g, or t
  misc_feature (43)..(43): n is a, c, g, or t
  misc_feature (45)..(45): n is a, c, g, or t
  misc_feature (48)..(48): n is a, c, g, or t
tgccacctcctatgtgcggaccaccatcnncaagnntgcnngngnccnccagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaaaaaaaaaaaaaacaaaaaaaaaaaaaaaaaaaaaaaaaaaaaaaaaaaaaaaaacaacaaaacaaaaaaaccaaagaggcgcggggcgcgccccgaacaaaacatactacccgagcggggcggggacgcaccagagagcagccgcgcaccccgaactctggagaacaaagagagaggcgccccacagagagagcggcaggatcaacataaagcagccgaccagaccggcagcgcaaaaacaacacagcgccgcgggaaaaaaaaatgcaggcaccgacgaacctcgggaagcgaacccacaccccccggtggcgggccaaacaatagagcgacccccacacccccagaagataaaacgccgacggacgagacaaacacacgg

SEQ ID NO: 438802 - DNA, 694 bp, Homo sapiens
  misc_feature (1)..(1): n is a, c, g, or t
nggctccacccggtggggccgttctagaactagtgattccccgggctgcagaattcggcacgaggggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaagaaaaaagcccaaggagacaacaaaaaaaaaggggggggcgccaaaaaagaacccccggggggggcccaaagatagggcgacgcccacggttgtggggacaaaaggggggcgccaaaaggggggcgcaaaaac

SEQ ID NO: 438803 - DNA, 346 bp, Homo sapiens
  misc_feature (3)..(4): n is a, c, g, or t
  misc_feature (6)..(7): n is a, c, g, or t
gcnncnnctactactactactactaaattcgcggccggtcgacagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438804 - DNA, 503 bp, Homo sapiens
gctgataccgcccccggaatttagcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataagtcgcgtgcctatccct

SEQ ID NO: 438805 - DNA, 674 bp, Homo sapiens
  misc_feature (19)..(19): n is a, c, g, or t
  misc_feature (32)..(32): n is a, c, g, or t
  misc_feature (57)..(57): n is a, c, g, or t
  misc_feature (311)..(311): n is a, c, g, or t
ccccggcatgtgctgtagnccagcgagaagtnccacagcgacgatgcggtgcgccgnctgtgggtgtccgtccatgccacggcacacagcgcgatggggtggtcggggatgacatggatgtcggtgatgcgctgttccagcagcaggtcttcggcttcgaagcgtcgggtcatgtagggcgccgtcagggcaaaagaaaaggggcggacccgcacctggcgagccgcccccacgacctgcggcttaacgctgctggcggttgccgccctgctcgcggttcgagccttcgttgccgcggttggcctcttcangctgtacatcgagctcggtacctggcgatgtcgcgtgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatggcacgcgacatcgccaggtaccgagctgatttattg

SEQ ID NO: 438806 - DNA, 669 bp, Homo sapiens
tctagaggatcccttcggctctaccttgtttcaaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaaacgccggggacccggccccccaacccaaaggagcttcccttggaaggcccccccttggcccccccaaggaaggcaaattaaaaggttcaaggcttgggctttttctcaaaaataaacagaacaaagaaaaagaacaaaaaaaaaggcacgaccaggaaaaaaaccaccgtgcagcagcacaaaaaatgggggggcccccaataaacccccccgggcgggcc

SEQ ID NO: 438807 - DNA, 3585 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagctccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438808 - DNA, 1606 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaaagaaaaaaaaaagaaaaaaaaacgagaggaagaagtatcaccgcggggaggggcggctaaaagaggaggggcggcgggggagcgccaccgagggagagacgagagaaaacaaagaggaggggggaccccacacggacgaggggagcagcggcgcgggcgaacgggggggaaagaagagaaacagaggagccgagcaagagcacgaagaacggagacaggagtaaaagacgacgcgcaccgcgcggaggcagcgagacacgagagaggaggcgggcggaaggagagaagagaggggagagaaaacaccaacaacggagcgcgcgagagcgggggcagacagacgcagacggtggtgagaccagaaggacagcgagagagggagatgatttatgtgggataaaaaccaaacaaggagggcaagcaagagagaacgtgaaggaagcaaagatagatagaaaaaaagacggacggagaggcgataccacatctaaaatgagagaggcagaacaaagaccggaggtgggtaggtagtagcgacagactaatttttatagaggcaccacacgccccgggagcgagaaaaacaccaagacaagaaagagagagacgcagagggaggcgagggaagcacgagaacgaccgctgcccgggggaggcgcccacgcggcgagccctcacccgcgcaagagcgacagcacaacgaagaagagcaacacgctaccgcgacgaagacgaacaacaagggctccgagacaaggagcgggagacaggtcggtgaggggaagtacatactagaggcgcaggacgacacacctgagcaagcacaccgagcaccaagcagaacgtagctattatcctccaaccttcatgcagtagcgcagtgcggccaaggcaacaacgacgaggaacgcagccggcagccgccgtcccgtcacacaacagacggagtcgattcataaggagaggtatcgtggcttatgctcacacccacacaagtagcgtaggtgaggaacgtaaggtg

SEQ ID NO: 438809 - DNA, 822 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaagaaaaaagaccggggcgcttcgagagatgcgcgttactcagaagtcgaccgagcgtgctcatccggaagctgccctcccagaggtgggcgagggagatcgcgcggatttccaaaaccgacctgaggttcagagcgcagccatcggtgcgctgcagaggctaacgaagcgacccgggggcctgcccaagatccacccgggtgcaccacgcagagagccccatggccaaaaccagggccccgacagggaaaccaagagggt

SEQ ID NO: 438810 - DNA, 656 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccatggcgctggccctgcgatgctgccatgcgcaggtcgggcggataattgttcttgcggatcatgtgtctgatgctgctgagcgtggcgcgagcattcttg

SEQ ID NO: 438811 - DNA, 548 bp, Homo sapiens
  misc_feature (539)..(539): n is a, c, g, or t
  misc_feature (546)..(546): n is a, c, g, or t
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagncagctgnct

SEQ ID NO: 438812 - DNA, 505 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaatttaaagcccgccagagttg

SEQ ID NO: 438813 - DNA, 623 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctaatagagaagaatcaacaaaatgggttccctaagaaaatccaaaggaagaaatcctcggaa

SEQ ID NO: 438814 - DNA, 1084 bp, Homo sapiens
aggatccttaattaaattaatcttccccccccccccgctctttccgtctcaggtccccgctttccgtctcaggtcaggtcgccgctgcggagggagccgcctgagcgttcgtcttcctcgcgtggtcgccatctccggcccgccgcgcactccctctcagtcctctgcctgccttctccccttgcgcctcaagggtcattggcggaccccaacccctccccgtgaagtcgttgtgaattttcaagttattttcccctcactctcattcgccgcagctagtctcggctgcctgaattcggtcccgccgccttaggtcactcagtcccgcctgacaagagttctaggtcgctgtctgccctcaggggtctcccattcacccaagttcccagtcgctctcttcctctgctgtccgagcgtggcccgtggcctaacgctgctttagttctctgtgtctgacgctttccctgtgcccgtttccccgcagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccgtaaaaaaaaaaataaaaactcgagggggggcccggttcccaattgcacctattgggagtccgattccatttactggccgacgttttcctacggcgggatgggaaaaccctggtggtccccactttaatcccttg

SEQ ID NO: 438815 - DNA, 487 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatggcgctggccctgcgatgctgccatgcgcaggtcgggcggataattgttcttgcggatcatgtgtctgatgctgctgagcgtggcgcgagcattcttg

SEQ ID NO: 438816 - DNA, 5438 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggcaggaagagcggtaactgccatcgcggcgggcatccctggcgccagggtgttggtctgggtaccggcttccctctcggccgacttgtcagctctgtgagccgcgcgcgtctgagcccgtgtcctcacctgtaaagtggagaaatgaaaaaggacctgaacttcctcggtggttgttgagagttaaggcacggggttgatgttttcagatgaaattctcaaagcaagtcagggtggggatggatggtttcatcccacaggtgggaagattgaggcacaacaggggaggggccctcgctaccacacttaggaggggacaggctgggttggttgcagccatttgattcccattttgcctgtgtaggttagagaagaggtcttggggaccccactccatacattgtgctgtcaggtgcaggcctttttggggattccctgaatgttcgtgtgagtcgggggtctctaatggaggagtccagcttcacatgtgttcttgacagggctgtattttctttttagagtgagtttttctcaggtccttgattggaactgcctcagagccaagggtccttttactcagtggcagcaacaaacgcagtctgttggctagtgatcctcctgtctcagggacacgtagtccagggagcagccaattgcttggcacttggggaccccgttctggggagtcctgaaagctttcacctcttggattgccgaatacatgggtggcccttcctagactaagggactggcctgagtgaggctgggcctctcagccaagctgatgttgaaccactgctgtggggatgggcctggggttcctgggaagctgttcatacccattgccaggagcgtgggctctggctggacctggatcagatcctaactgaagcggcagctttctggcatgagaaaggagtgttttcatggtggacagaattgggctatgagtgtggcagaagctgtgtcctcagtactccgtgatgacgagtgagcctctgtgaaatggacaggtgggaaaacagctacctgctggcctgcccaggcacccgccacgggcccacgctgctcagcttctcaatgtgagactgtccacacctgcgaggtgtgctaaaggtgcaggttaggtggactgaccccaggacctccctgacccccaaccaggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacctgcctcgactgggcctccctttttgaaacgctctggggagctctggccctgtgtgttgtcattcaggccatgtcatcaaaactctgcatgtcaccttgtccatctggaggtgatgtcaatggctggccatgcaggaggggtggggtagctgccttgtccctggtgagggcaagggtcactgtcttcacagaaaaagtttgctgacttgtgattgagacctactgtcccattgtgaggtggcctgaagaatcccagctggggcagtggcttccattcagaagaagaaaggccttttctagcccagaagggtgcaggctgagggctgggccctgggccctggtgctgtagcacggtttggggacttggggtgttcccaagacctgggggacgacagacatcacgggaggaagatgagatgacttttgcatccagggagtgggtgcagccacatttggaggggatgggctttacttgatgcaacctcatctctgagatgggcaacttggtgggtggtggcttataactgtaagggagatggcagccccagggtacagccagcaggcattgagcagccttagcattgtccccctactcccgtcctccaggtgtccccatccctcccctgtctctttgagctggctcttgtcacttaggtctcatctcagtggccgctcctgggccaccctgtcacccaagctttcctgattgcccagccctcttgtttcctttggcctgtttgctccctagtgtttattacagcttgtgaggccaggagtttgagaccatcctaggcaacataatgagacaccgtctctaaaataaaattagctgggtgtggtggtgcaccgcctgtggtcccagctcctcagaggttgagtagaggctgaggtgagcggagcacttgagccaagagtatgaggctgcagtgagcccatgagccccaccactacactccagcctggaagacaccatgacacacagtgaggcctggatggggaaagagtcctgctgttgatcctcacatgtttcctgggcacctaactctgtcagccactgccagggaccaaggatccagcatccatggcacccctggttcctgccatcctggggtacccgattcaaagagggactctgctccctgtctgagaccacccccggctctgactgagagtaaggggactgtcagggcctcgacttgccattggttggggtcgtacggggctgggagccctgcgttttgaggcagaccactgcccttccgacctcagtcctgtctgctccagtcttgcccagctcgaaggagagcagatctgaccacttgccagcccctgtctgctgtgaattaccatttcctttgtccttcccttagttgggtctattagctcagattgagaggtgttgccttaaaactgagttgggtgacttggtacctgctcaggaccccccgcactgtcccaatcccactcaggcccacctccagctggcctcactccgctggtgacttcgtacctgctcaggagcccccactgtcccagtcccactcaggcccatctctggctggcctcactgcgctgggactccgccttcataaggagagctcactgctcacgttagtagatggccccttctcgtgaggcctctcccctggcacctgcttcagttgtcctccacagcactgatttgcagcccacaagctggcaggtttatctgtctcatgtttgtcttgtgctggtgggcaaggggtttgtctagcacaccagcatataatgagatgcttgatgaatggtgcatattgaatgtataaagcccaccggtcctgagagtttgctcactggagactttctggagatggagtctcgctctgttgcccaggctggcgagtgcaatggcgcgatcttggctcactgcaacctccacctcctgggttcaagcgattctcctgcctcagcctcccgagtagctgggattacaggtgggtgtcaccacacccagctcagtattgtatttttagcagagatggggtttcaccattttgcccaggctggtttggaactcctgacttcaaattacccacctgcctcagcctcccaaagtgctggcattacaggcgctcgaggctttctgatgtggctgctgctgctcagaaggccttgtccttaaccacctccttgcctgccctggaggcttgtgcctctaggccccaccccctgtggagtcctgctggctttctccatccctatctgaatcctccctgctgtgtggcctcccctggtctcatccgtaacacagcccagcttagtgggcctctgttcctgcgggtggccagcctgtctgtgtggctgggctggggaggccacgtctggtatctgaatgctatcggtgggttggggtggaggaaccaggagagggctggagggagggagatggtctcagccccacagagtttggagtcctcagtgtgctgagcaaacgtggagacaccatttccctcctctagacctcatcttggagagagagatgttggatggggccatctattccagctttattcacacaaatcatgtctgttggcctggaaattggaaaaccagttaaaccaaaaacatgatattaagaaaacaggcaggctcaccatagtaaaaatgctgaaagccaaagacaaaattgggagaacaaaagaaaagcgtcttgtcacatacagaaggtccctgataaagttagtagctgccctcatcagaaaccaggcccaggcagtggggacacatccagagtgctgaaagaacctcccccaggtcatcctatccccaagagtgatgcccggcagcattcccagctcagggctaatggttcacggaagccaggaatcaaactgcctgggttccagtcccagctctgccagttatgcccagctgtggggacttgggcagctcgtttagtagcaccgtgcctcagtttcccatatgtaaaaggccattttgagtgcctttcacagccctgcataaggcaggtgtctcagtgttcactgctgtctctccagctcttagtccagtagctgcatggtgagtgagcgtagggcgcaccctggaaggctgccaagcccaaagttgtgcagagcgctggggactccagactccccacagcagcagagactcgggactgaggcatcctctgttcacaggacatgctggcatctactgggtcagggctctgctgctcggtggctgtgcaaccttgggcaagttcctcaacctctctgtgtcttcgtaccctcatctgtaacatgcgtgtcgatagaccctactactcagggttgatgagaagattaaatgtgcaaaacctgcttgactgtgcccacaaatcctgattgtaggaataaattaatgactttttataaatattttgatcagatggactcagatgatcacagatgtcttcacatgcctatgactaatttgtacacaaactaatgctcgtgtttcccaagcacctggaagacatgccagatccatgtgcagtaatgcctggtggctccaggtctgccccgccgtcctgtggggctgtgagctttcccagcctcctgcccgtgtttgtgaatatcattctgtcctcagctgcatttccagcccaggctgtttggcgctgcccaggaatggtatcaattcccctgtttctcttgtagccagttactagaataaaatcatctactttaaaatctttca

SEQ ID NO: 438817 - DNA, 755 bp, Homo sapiens
aggatccttaattaaattaatcttccccccccccccgctctttccgtctcaggtccccgctttccgtctcaggtcaggtcgccgctgcggagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggtgagctggggtttggggatcaggcttggggagactggccagtgctgtggggaagggcctcccactactggttgcaatatgggctggagagggatggattcttgctttcagcctactccccacacccagcattggcctagggggcggcttgtggagtgtatgggctgagccttgctctgctcccccgcccccaggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438818 - DNA, 546 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtgggccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatgaacacatccgcaggcacaccatcctgcgcagccagaagcctgtgatggtgaagaggaacgaacccaccccaccaagagataaagagaaccctgccaccagaaaaataaaatctgctacttcaaa

SEQ ID NO: 438819 - DNA, 922 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccatagaataaaagatcatatggatcatttaacttagcataactctatgaccacagaacaatgtaaagcgcccgggctgcaaaagagggcggagaccagatgaggaagtataaatgccatccaggcactatggctggttcatagcaactgcagactgtttttctggaacgggagtggcaatgatccgccggggggccctcccattaaagagggcagtggagataataatttggacagcccggcggttactgtgttattttttgctcgtctaagcaactgccctacgttaaaacgggtcaagcaaggccagaacctacttagtgtagtcggggcagcgtggactcatggagacccaacccccatccccg

SEQ ID NO: 438820 - DNA, 794 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaacaaaaaaaaaaaaaaaaaaaaaaaaaaaaaaaaaaaagacacggcggaggagcaacacatgtgggcggggcgcgagagaaagagaggtacaatgaaggggcacgagggggaacagagggacaccgcaccccacttcttgtcacacagggggacactacgggggccccccatagggggcagataatcagacaacacgtgtgccgcaatag

SEQ ID NO: 438821 - DNA, 556 bp, Homo sapiens
aggatccttaattaaattaatcttccccccccccccgctctttccgtctcaggtccccgctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438822 - DNA, 550 bp, Homo sapiens
  misc_feature (1)..(1): n is a, c, g, or t
nggctccacccggtggggccgttctagaactagtgattccccgggctgcagaattcggcacgaggggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438823 - DNA, 785 bp, Homo sapiens
aagacgccccaacagccccacccacaggttcacccaattacggctaggtacgaggcgggtggtggcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcaccaaaaaaaaaaaaaaaaaaaaaaaaaaaaacaaaaaaaaaaaaaaaaaaaaaaaaaaaaaaaaaaaagacacggcggaggagcaacacatgtgggcggggcgcgagagaaagagaggtacaatgaaggggcacgagggggaacagagggacaccgcaccccacttcttgtcacacagggggacactacgggggccccccatagggggcagataatcagacaacacgtgtgccgcaatag

SEQ ID NO: 438824 - DNA, 513 bp, Homo sapiens
cggacgcgtgggtcgcccacgcgtcgcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcggaagcctgccacctcctatgtgcggaccaccatcaacaagaatgctcgcgccacgctcagcagcatcagacacatgatccgcaagaacaagtaccgccccgacctgcgcatggcagccatccgcagggccagcgccatcctgcgcagccagaagcctgtgatggtgaagaggaagcggacccgccccaccaagagctcctgagccccctgcccccagagcaataaagtcagctggctttctcacc

SEQ ID NO: 438825 - DNA, 1402 bp, Homo sapiens
gtggtaccggccgggagtacgggatgaagtttccgggactgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438826 - DNA, 1685 bp, Homo sapiens
ttccggggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438827 - DNA, 2349 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattcaaaaaaaaaaacacaaaaatcaagtatgcggccgagttttcctttttttttttttttcgcactaccacttcacctagtctctatcccc

SEQ ID NO: 438828 - DNA, 2469 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattcaaacaaacacaaccaaaaactcggagggacatcaaatgcccggggtgccggcaacacagagcgctactgaacgcgggcacaggggccataagcaggttccggacccaggttcctggtacaccaggggtcagaatcgggcgggtaccccaatgggagcggtatattcgagtagccgcgtacctggtagaacacggcaaaggaacaagaa

SEQ ID NO: 438829 - DNA, 2122 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438830 - DNA, 1392 bp, Homo sapiens
ttttagctttattttagtaagtctttagtttactcattttgggctaaagcttttatgatgatatctggattaatgtggtcaaataaagtatgagcatttgcaacctgaatgatggtttacatggctagatttaccaagcagtagaccattctgtgtattatctgaaaatgtatgaatcagtctttcttgtccaagtttttcagagatttaagaatcttttggaaaataattctgaaaataatttgattttgtatgtccatgccaaagccctagattatggggactggtgatgtatatctaagggatgtgtgtatgttatgtaagcatgagaatgaatctttttaaaaagtcatttcttagaaattttgcctataatagtttacttttaaatcttaatctctcaccccccaaaactcccattttcccacaatattttctctaggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438831 - DNA, 2162 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaatatatctcatattcgcttagcccttggggtggggagaaccttagagtctcaagtcaaagtcgtggccctgtgtgctggttctgggagcagcgtgagatgtcccatcatgatactttggatgctgcttcccaaggaataaatgtcatcctctgtgaacacagcattctgaccttcgagatatgctggattctcacttggagaataagataaatattatcctatcagagactgacagggaccctcttcaggtggtattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438832 - DNA, 478 bp, Homo sapiens
cggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgaggtaacgtcgagggagcggtttgcaggttgcaaaggggccctactgatgctgcttaatagtaaacagtgcttactctaggacgggagttgtttccagctttacgtgtaaatctcgcgatattgtggcctgggcactatttccattaaggaggaaactgcacaggataagtcatttacctgctgttgcacagctctggctctaggattcaggctggcttcagagtcggtgctcttaaccgccatactatgttgccttctgttgtcgt

SEQ ID NO: 438833 - DNA, 1634 bp, Homo sapiens
ttccggggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438834 - DNA, 2261 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438835 - DNA, 1697 bp, Homo sapiens
ttccggggactggtgagtagtgggcgatttaaaaacccgcgagtgtagttgtgaccttcgcggtaggtgccggttggggccggctgtgattgttatcttggtgctgcagaggacagcagaagaggagattgggtcagaaaactgccctgccgcaccagagcacagcgcactagtgggacaggggtcctgactcagacttaactggctgtgtctcgtggtttttcactgtcctggaaaaggcctgaagtggcactgaaatgaggcatagatgagttggctatgctttcttattgtgcatactatgaaatgtttttcttcaaaaagtgtttataagtgtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438836 - DNA, 2301 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggtacaatttatttttctcttttttttgtgtgtatttattggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacaggtgagatgtcccatcatgatactttggatgctgcttcccaaggaataaatgtcatcctctgtgaacacagcaacactgaacgaggctttctttctgaccttcgagatatgctggattctcacttggagaataagataaatattatcctatcagagactgacagggaccctcttcaggtggtataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438837 - DNA, 2080 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaagcctttgcttctacatactggaatgggacggttatgcacactggatgaatctgtctccctggcaaccatgattgatcgaataaaaagacacctaaaactatctcatattcgcttagcccttggggtggggagaaccttagagtctcaagtcaaagtcgtggccctgtgtgctggttctgggagcagcgttctgcagggtgttgaggctgacctttacctcacagataattgcagaaacatcaggataacacattctacaaatcagctggatgccaacttaaatttgtaacatgagtcagtgggactggtgtgcttccagagagtgtcttcgagggtatcatcatttccggtttgttaatcttattcaccaaatgttctatcgctcgtaaggtaaaactgtaatataactaccatattaaataacaaatgttcattataaactctaggaaagattgaataaaatctgtttacttaacattc

SEQ ID NO: 438838 - DNA, 2490 bp, Homo sapiens
ctcccaggttcaagtgattctcctgcgtcagcctcccgagtagctgggactacaggtgcacaccaccatgcccagctaatttttgtatttttagtagagacggtttcaccacgttggccaggatagtctttatctcttgactttgtgatcctcacgaggcgccccgccacattattctgttttttggtaacgcacattgtaatgccagtatataccaccccaactccaaattctgttgcaatcaggggaggcgggcagtgtcattctatgcagtaagcatttagtgctggcttatattagtgatactgagatttattgaagttagttcctattacatagtagctttagcataatgggcacacacagaattatgagaatactgagggtagatgctggggagccttgggaaggatgctgaaaagggaggtcaagaaaagttttatttaagaagttggagggggcttgggaaaaggaaaggtaatatttagagaaatggattagggaggaggttggttgaagcaagggtagggagaataacaacaagggtgtgcaacggcaggagatgggatggacgtttgtgtattatgtaccaggcttgctaggttacataattcattagctcctctggatggcctgtgaagtgggttatagtatctctgtttcgtaggtgagaaaacaagattggagaggttaaatggcttacctaagttacagtgtgctggtaagtggcagagccactatttgaacccagatctctatgacgacagctcttttgcccatatgttttgatgcctcaaagatccaggcctaaagtatacctgtgtaccattttctttgttttgacatcagaaacttgaactttacctgatttctgtatgttgtcatcttgcgtacgcccagtccccacgacagtccggtttgtagattccctgatctgcaattcttcccgttccttcatggatttgaaggctctcctttcttccttgaatgactttgcatccctctcgtttgctgagagttgggacaatgttggattactggtggaaccaagcccaccacatactgtaaatacactcttcctgaccaatgacctgactgaggaagtgatggaggaggtgctgcaaaagaaggcagacctcattctctcctaccatccgcctatcttccgacccatgaagcgcataacctggaacacatggaaggagcgcctggtgatccgggctctggagaacagagtcggtatctactctcctcatacagcctatgatgctgcgccccagggcgtcaacaactggttggctaaagggcttggagcttgtacctccaggcccatacatccttccaaagctcccaactaccctacagagggaaaccaccgagtagaattcaacgttaactacacccaagacctggacaaagtcatgtctgcagtgaaaggaattgacggtgtttctgtcacttctttttctgctaggactggtaatgaggaacaaacacggattaatctgaattgtactcagaaggctttgatgcaggtggtagattttctttcccggaacaaacaactttatcagaagacggaaattctgtcactggagaaggaaggtaataagaatattttgtatttgatcttaaaatactgtgcacacattttctaacagtataattgaggtataattgatatacttaggtatattgaggtatgccttattgaggtataattgatatactaagaattgtacatatttgatgtgtacaatttgatgaatatcattactttgcatttttcttcagcaaattcatttgtaaattattagatcaacaggccattcactgttatctaaagtacaaaatggcaatgagagcataatattctctaggaagtaattgagaaagggagacattccaggaacaggaaaatattggtacgtcttcagggttacagatttggttacaggtttgctgtctccttattttacacgctctgcctggaccatgtcattcacttctttaacttgatagccatttgtatgatgatttctatctttactttttggcttagaatgctttcttaagggaaaaaatgacaagaacccatattttcatctactttctggatgttttgcacttacagagcccacaagtatttcaaattcagtatatccaaatactttatccgtttgccacccccgcttttttttttttccatatttcatatttcagtatcattatctactttagtttccaagttttcacattcctccttgactccaggccctgctgagtctggcctcatatctatacagtgtttctcctctgtattggctctgccaccacagtagttgaaactctcattttctgcgatgagagtagtctcaccgagcacctaggaggcagtccaggctctttagcatggtgttggaagcccttaatgatctgctacagcctgggcctccagcctcctctccttccacagcatgtactctgcac

SEQ ID NO: 438839 - DNA, 2190 bp, Homo sapiens
gatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaataaataaaatacttcttctgtcaaaaaaaaaaatacttttttaagtatataagattattaaagatttctttcagatttttaatttcacccttctgtcctgccgtaacacttcattagatcaaacaatatatgtaattaaaataaactgaatctaagtc

SEQ ID NO: 438840 - DNA, 1309 bp, Homo sapiens
gatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaaggtaatagcctatttaaaaatatttaaacaaattcaataggatttattagatttgttattgttttattttaatataagaaagtcctaaagacaaaaacaaatagttacataaactcaccaggcagataacccaatggatagtaaa

SEQ ID NO: 438841 - DNA, 1138 bp, Homo sapiens
aaggcaagactaatcatacatgcaacagtgagaaataatttaacgcccagacccctctacatcccacgggaacagaagtactgtcagctttgaaggagaaggcttcatggaggagctgtgacttgactccagagtgaaaggataattaggattgatacaggacggaggaaggaaggcatccaggcaatctcaataaaagcatccatgagtaaaagtttccattatttctttattaagcccagaacattaccaggcctagtgttgaactataattattgttgacaggaataacaatattcttgtttaaactaattgagaagtcttttatctctacttcccataccagggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaataaataaaatacttcttctgtca

SEQ ID NO: 438842 - DNA, 920 bp, Homo sapiens
cctataaagtctagaaatgagtttgttactatacttttcaccaacccaaataattggttactggaggataagtgcatacctgtttataagatttatttcatattttgatagcaaactatttatagggcaaccttaggataaccttgtattctggactctccttgagtttcaaaaataaagaaacaaagacacaacgtccagtaacttggacagttactcagtgacagactaagtttcaagttttttaaagtattgcattgtattattgccctcaggctatgtatgtatcctgcttagaaataactttattttaggaaaatattggggataagttaaatttgatagttttaaaagaaattttatagtcactgtgctgtaatcttgattacctatctgttctagttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaataaataaaatacttcttctgtca

SEQ ID NO: 438843 - DNA, 639 bp, Homo sapiens
ccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctgtgaggcatcatttattttcatagcaccttcctctccttgtagaataattccaggatcaggaagaaacgaggggctcctgttattagcatccacaggaactagcatagctgcccactttatctccgtagactctctatcccttcatccctg

SEQ ID NO: 438844 - DNA, 2055 bp, Homo sapiens
gatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcaggttaactctgacctggaggtggcatctgtcctatttaaagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaataaataaaatacttcttctgtca

SEQ ID NO: 438845 - DNA, 2293 bp, Homo sapiens
gatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcatcttgaactcctgacctcaggtgatccacctgccttggcctcccaaagtgctggggttacaggcgtgagcaccatgcccagcctagactttttttttttttgactaaccattatgcaaacaaggaagtatggactttaatgataaaaacaatttagtatcacttgataaatagtttaattgaagctattacacctcatgtatttcttttcaaatgtagacattgacatagaactcttactgaaatgcttttaatgtgtttacatttgtttttcacttagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaagaaaatgttatcaatcacacggatgaagaaggatttactcctctgatgtgggctgcagcacacgggcaaatagctgtggtagagttcctacttcagaatggtgctgatccccaacttttaggaaaaggtcgagaaagtgcactgtcgttggcctgtagtaaaggctacacagatattgtcaaaatgctgcttgattgtggagttgatgtaaatgaatatgattggaatggaggaacacctctgctttatgctgtacatggaaatcatgtgaaatgtgtaaagatgctcttagaaagtggggctgatccaacaattgaaactgactctggatataattctatggatctagctgtagccctaggctatagaagtgttcaacaggttattgagtcacatttgttgaagctgcttcaaaatatcaaggagtagacacagtcatcagaaaatgtctgcccttttgtttacttcttggtccttataaatgatagttttgtttacttataaatttttacctcagttgcaatatttactggtttttagtaggttttaataaatatttctctgagtaattcactggtttataataaatgtaatactctttttataactatgttttactgtatatttaaaattataaattaatgttttcgtggcatgtaaatttttatggtacagatagttatcatcagtctttgtatcaagtgctgtaatttgacattttcagaaattattctaccctagtcatcttcactcgtgtattaagtcattcactttatatagggtttgctataaatccctagaaaaaaattgttcttattgttgaattaaaaagtgcacagtgtgattgtttacaaaatgatattataaataaataaaatacttcttctgtca

SEQ ID NO: 438846 - DNA, 1547 bp, Homo sapiens
gatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaagtgacgtcgcggccaaaacaagcccgggcttggaggcctgtactgaagctggcctcagatgggaaggcccgactcgctgtctgctgtcgtcggtggtcgcgagaccttgcactctcaccgggtcggcctccagcccctgtgcccgggatccgctcgccgcggatgagcgagagtttcttcctgggacttttcgggcacagctggccggtggcgacagaacggactttctttcctgcaagagtctcccctccagcgggagacagcgggctcctgtctcgggacgctgggacacctgtcgcctatttttaaatatccagattccaagaacacactggatactgctcttacaaaaccaagaggaaatcatgaagaaatgttttagttattgaaactacagttgaaatcatggatacatcaacaaatctggatattggagcccagcttatcgtggaagagtgtcccagcacttatagcctaactggcatgccagacattaaaatagaacatccactggacccaaattcagaagaagggtcagctcagggtgttgccatgggaatgaaattcatattgcctaaccgatttgatatgaatgtgtgttctcgatttgtgaagtccttaaatgaagaagatagtaaaaatattcaagatcatcttgaactcctgacctcaggtgatccacctgccttggcctcccaaagtgctggggttacaggcgtgagcaccatgcccagcctagactttttttttttttgactaaccattatgcaaacaaggaagtatggactttaatgataaaaacaatttagtatcacttgataaatagtttaattgaagctattacacctcatgtatttcttttcaaatgtagacattgacatagaactcttactgaaatgcttttaatgtgtttacatttgtttttcacttagctgaatgcaatatccatacatctccttctccgggaattcaagtaaggcatgtctacaccccctctacaacaaagcatttctcacccataaaacagtcaaccactttaaccaacaaacacagaggaaatgaggtctctaccacacctctgttagcaaattctttgtctgttcaccagttggctgctcagggagagatgctctatctggctactcgtatcgaacaaggtaatagcctatttaaaaatatttaaacaaattcaataggatttattagatttgttattgttttattttaatataagaaagtcctaaagacaaaaacaaatagttacataaactcaccaggcagataacccaatggatagtaaa

SEQ ID NO: 438847 - DNA, 5257 bp, Homo sapiens
gaattccttttttttttgagctttaaataaagcatttattcatgagcggaagcttacagtttgcatagattcttcataccttatctggaagggcgatggaaaccccaaggcactagagagcatcagaagaaatcagtgacatgatttgagtagggctgggggactgggtccctgcaccccagccacatcctatgggccttaggcccatactcggagaacgagtccattggacaaagaacatggctgagagaccttctgggggccttgaagaggccgcctccttggtctcctcaaccccagtgtaagtctggggaggcccaaggtgagggtcatgtatcgggatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatgacaatgagtgttcatctaaagcaaatgacatagtttgcctaatccagtactgtagttcacagatagaagaattaagattttaatgggacggtgatttgccagcagtccctactgaatttcttaattaagatttgtgcccaactgtcctggtctctaaactggtgtcatgtttcctccttattccatcatgtccctgatcatagcctgccaatctggatgtagaactctctgctgctctcctggaatgatgtctacctgcatgctgccatgcctcccaccatgacaataattgactgaagctctgaactgtaaggcagccccaattaaatgctttcctttatagg

SEQ ID NO: 438848 - DNA, 435 bp, Homo sapiens
aacttagcagctggggtttcttggccagtcatgccaactgtggctaggcctgttacagttttggtttgctgtccctgttgctgtcaataaatatcagggcctttggaattcagaatggtctcattctctatgtatatgtcttttccagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaacgcaactacctgagaagaaacgcaactacctgagaagaaacgcaactactgagaagaaacgcaactacctgagaagaaacgcaactactgagaagaaacgcaactacctg

SEQ ID NO: 438849 - DNA, 8054 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagctatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438850 - DNA, 5779 bp, Homo sapiens
taataatttattcaacaaatgttgctctcacacgttgtgtgttgggctacactggggtctagggtagtagtatagtacttggtacattatgaagtgattttcatatgtaatcttcatagcagtcctgtgaggtataggcatttttaagtatctctgttttgtagatgaggaaaactaaacttagacatgttaaatagcttaaatagacatgttaaatcatagaggtaatggcagagctagcatcatctgaattcacatcctgtattttctcccctactgactctgaaagatagtggatgaaaaattgtttagtcacatttgataatctatattttaatttatttgtattactggatagaccctagatggccgtaattaagatggagagcaataagcttggtatttctttctcagcagttgactgaatttcctagggctactctgtatataatttttgtgtttttacttttgttaggcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagctatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438851 - DNA, 1917 bp, Homo sapiens
agaagggggcacggcgggggtttaaaaccccccctttccctccagcctttctgtcgatgatctccacagcccacccatcccctgagcacactaaccacctcatgcaggccccacctgccaatagtaataacgcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaagtag

SEQ ID NO: 438852 - DNA, 6087 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcaggtaatcgacagcaacatgctacagggctgtggcatcagtgcccagctatgatgttgaggggcccaacatcagattacttttcatccatcaaacatttcctgggcacctactagggccaggcactgtgctaggctctggggatacacagaggagcaaaacatatc
